United States Patent 11,446,398 (REGULATED BIOCIRCUIT SYSTEMS) - sequence listing, part 49

SEQ ID NO: 139987 - DNA, 6692 bp, Homo sapiens
  Payload ID: 7455
  Gene Symbol: HECW2
  Gene Name: HECT, C2 and WW domain containing E3 ubiquitin protein ligase 2
  Uniprot ID: Q9P2P5
  ENST ID: ENST00000409111
  CDS Start-End: 1016-4666
tgtggccacgactgcctcagccgaggggatgtgatacattttttcacttaggatgcctggacagtgataagtcttgatgaaaggcaggagtggcttttagtgtcattcatactggacaggagcctcttgttagagacctgccggaatcctgtctagtatttcatttctagaactttgggggaagaggaagagaagcaggagcatccgtgaagtggacctgcagagctttcacagccaccttagaactccagacccgccttgacttcagttcagctctggctgctcctatgaatgaaactgccacgtgggttggccaggtgtatgattttaaggaagaatgccatgtttcttcttgctgctgcctaagtctcatttgactgatggattttaaaacctttgggattatatgagatgagaattctccagccaacttctgggattctaagaacaggggtgtgactggaacacaaaaagggcaaattgtatggagaattgagcctgggccctatttcatggaaccggagataaaaatctgttttaaatattaccacggcattagtggagccctgcgagccacgaccccctgcatcaccgtgaagaacccagctgtgatgatgggggcagaaggcatggagggaggtgcttcaggaaacctgcattctcgaaaacttgttagctttacattgtcagccaggaaagaagagcagtttccccacctgtgcccaccacgggcaggagagacggtctactatcatcagtaacaccaccaatccaatttggcaccgagagaaatattccttttttgcacttcttactgatgtcttagaaattgaaattaaagacaaatttgccaagagccgtcccatcatcaagcgttttctggggaaactaaccattccagtccagaggctgctggagcgacaagccatcggatgcctctccagaagctgttggcacaatacttggagtcaattctgtgaatggagacttaggtagcccttccgatgacgaggacatgccagggagccatcacgacagccaggtgtgctctaatgggccagtttctgaggacagtgctgccgatggaacccccaagcattcattcaggactagctccactctggaaatagacacagaggaattaacctctacgtcttcaaggacctcacctcccagaggacgtcaggattcactcaatgattacttagatgctatcgaacacaatggccactccaggccggggacagcgacctgctctgagaggtccatgggtgcctctccgaaactgaggagtagttttcccactgacacaagactcaatgccatgcttcatattgattcagatgaagaagatcacgagttccagcaagacctgggttacccatcttccttggaggaggagggaggcctgatcatgtttagcagggcatccagagctgatgatggaagcctgacatctcagacaaagctggaggacaaccctgttgagaatgaggaagcctccacacacgaagctgcttcctttgaggataagccagaaaatcttccagagcttgcagagagctccttacctgcaggcccagccccagaggaaggtgaaggcggcccagagcctcaacccagtgctgaccagggcagtgctgaactgtgtggctctcaagaggtagatcagcccacaagtggcgcagacacagggacttccgatgcatcaggaggaagccgaagagccgtcagtgagaccgagtctctcgatcagggctctgagccttcccaggtgtcctctgaaacagaacccagtgatcctgccaggacagagagtgtgagcgaagccagcaccaggcctgagggagagagtgacctggaatgcgctgacagctcctgcaatgagagtgtgaccacgcagctgtcctctgtggacacacggtgctcctctcttgagagcgcacggtttcctgaaaccccagccttttcttctcaggaggaggaagacggagcctgtgcagcagagcccaccagcagtggccctgccgaagggtcgcaggaatccgtgtgcactgctggttctttacctgtggtacaggtgcccagtggggaggatgaagggccaggggcagaatcggccactgtacctgaccaggaggagctgggggaggtctggcagcggagggggagcctggagggagctgcagctgctgccgagagcccaccgcaagaagaaggcagtgctggggaggcccaaggcacctgtgaaggggcaactgcccaggaggagggcgctactggaggttctcaagccaacggccaccagccactgcgatcactaccttcagtgcgccaggatgttagccggtaccagagggtggacgaggctctcccaccaaactgggaggcacgcattgacagccacggcaggatcttctacgtggatcacgtaaacagaaccacgacgtggcagcgaccgacagctcccccagccccgcaggtgctgcagagatctaactccatacagcaaatggagcagctgaaccggcgatatcagagtatccgcagaaccatgaccaatgagaggcctgaggaaaataccaatgctattgatggggcaggggaggaagctgactttcaccaagccagtgcagatttccgacgggagaacatcctgcctcactctacctccagatccaggatcacgttgctgttacagtctccccccgtgaagttcctcatcagcccagagttcttcaccgtgctgcattctaaccctagtgcctaccgcatgtttacaaacaacacgtgtttgaagcacatgatcaccaaagtccggagggacacccaccactttgaacgctaccagcataaccgcgaccttgtgggattcctcaacatgttcgcgaacaaacagctagagctgccgcggggatgggaaatgaaacatgatcaccagggcaaggcattctttgtggaccacaactcccgcaccaccactttcattgatccccggctcccacttcagagcagtagacccacaagtgcgctggttcatcggcaacacctgacaaggcaacgcagccacagtgcgggtgaggtaggagaagattctcgacatgcaggaccaccagttcttcccaggccatccagtacattcaatacagtcagtaggccacagtaccaggacatggttccagtggcttacaatgacaagattgttgcatttctacgtcaacccaatatctttgaaattctacaggagcgtcaacctgatcttaccaggaatcactcactcagggagaagatccaatttatccgaactgaagggactccaggattggtgcgcctttcaagcgatgcagaccttgttatgttgctgagcttatttgaagaagagataatgtcgtatgtgcctccacatgccttactccaccccagctactgtcagtccccacgtggctctcccgtgtcatctcctcagaactcgccaggtacccagcgtgccaatgcccgggctccagccccttacaagcgggatttcgaagccaaactgaggaacttttacaggaagttagagactaaaggatatggacaaggcccagggaagttaaagttaattatccgaagagatcacttactagaagatgcttttaatcagattatgggctactccagaaaagacctgcagagaaataagctatatgtcaccttcgttggggaggaagggctggattacagtgggccttctagagagtttttcttcctggtatccagagaactctttaacccatattatggcttatttgaatattcagccaatgacacatacacagtacaaataagtcctatgtctgcttttgtagacaatcaccatgaatggttccgattcagtggtaggatccttggtcttgcactaatacaccagtatttgttggatgccttcttcacacggcccttttataaggctcttctcagaattctatgtgacctgagtgacctagaataccttgatgaagagttccatcagagcctgcagtggatgaaagacaatgatatccatgacatcctagacctcacgttcactgtgaacgaagaagtatttgggcagataactgaacgagaattaaagccagggggtgccaatatcccagttacagagaagaacaagaaggagtacatcgagaggatggtgaagtggaggattgagaggggtgttgtacagcaaacagagagcttagtgcgtggcttctatgaggtggtggatgccaggctggtatctgtttttgatgcaagagaactggaattggtcatcgcaggcacagctgaaatagacctaagtgattggagaaacaacacagaatatagaggaggataccatgacaatcatattgtaattcggtggttctgggctgcagtggaaagattcaacaatgaacaacgactaaggttgttacagtttgttacaggcacatccagcattccctatgaaggatttgcttcactccgagggagtaacggcccaagaagattctgtgtggagaaatgggggaaaatcactgctcttcccagagcgcatacatgttttaaccgtctggatctgcctccctacccatccttttccatgctttatgaaaaactgttgacagcagttgaagaaaccagtacttttggacttgagtgacctggaagctgaatgcccatctctgtggacaggcaggttcagaagctgccttctagaagaatgattgaacattggaagtttcaagaggatgcttcctttaggataaagctatgtgctgttgttttccaggaacaagtgctctgtcacatttggggactggagatgagtcctcttggaaggatttgggtgagcttgatgcccagggaacaacccaaccgtctttcaatcaacagttcttgactgccaaactttttccatttgttatgttccaagacaaagatgaacccatacatgatcagctccacggtaatttttagggactcaggagaatcttgaaacttacccttgaacgtggttcaagccaaactggcagcatttggcccaatctccaaattagagcaagttaaataatataataaaagtaaatatatttcctgaaagtacattcatttaagccctaagttataacagaatattcatttcttgcttatgagtgcctgcatggtgtgcaccataggtttccgctttcatgggacatgagtgaaaatgaaaccaagtcaatatgaggtacctttacagatttgcaataagatggtctgtgacaatgtatatgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggttcattatgtttatgttctttaagatgtatataagaacctacctatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactccatcacttgagaagtataatagaaaatagcttctaaatcaaacttccttcacagtgccgtgtctaccactacaaggactgtgcatctaagtaataattttttaagattcactatatgtgatagtatgatatgcatttatttaaaatgcattagactctcttccatccatcaaatactttacaggatggcatttaatacagatatttcgtatttcccccactgctttttatttgtacagcatcattaaacactaagctcagttaaggagccatcagcaacactgaagagatcagtagtaagaattccattttccctcatcagtgaagacaccacaaattgaaactcagaactatatttctaagcctgcattttcactgatgcataattttcttattaatattaagagacagtttttctatggcatctccaaaactgcatgacatcactagtcttacttctgcttaattttatgagaaggtattcttcattttaattgcttttgggattactccacatctttgtttatttcttgactaatcagattttcaatagagtgaagttaaattgggggtcataaaagcattggattgacatatggtttgccagcctatgggtttacaggcattgcccaaacatttctttgagatctatatttataagcagccatggaattcctattatgggatgttggcaatcttacattttatagaggtcatatgcatagttttcataggtgttttgtaagaactgattgctctcctgtgagttaagctatgtttactactgggaccctcaagaggaataccacttatgttacactcctgcactaaaggcacgtactgcagtgtgaagaaatgttctgaaaaagggttatagaaatctggaaataagaaaggaagagctctctgtattctataattggaagagaaaaaaagaaaaacttttaactggaaatgttagtttgtacttattgatcatgaatacaagtatatatttaattttgcaa

SEQ ID NO: 139988 - DNA, 568 bp, Homo sapiens
  Payload ID: 7455
  Gene Symbol: HECW2
  Gene Name: HECT, C2 and WW domain containing E3 ubiquitin protein ligase 2
  ENST ID: ENST00000427457
  CDS Start-End: 215-568
agatgccgccgaagcgtctagcgggaagggcgccggcgcggctggagggtctcagtacagggtctctgagcctgttgcccaatctggagtgcgatggtgcagtcacatctcactgcagccttgagctcctggactcaagtgattctccacctcagccttcctcatagctaggactacagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaa

SEQ ID NO: 139989 - DNA, 620 bp, Homo sapiens
  Payload ID: 7455
  Gene Symbol: HECW2
  Gene Name: HECT, C2 and WW domain containing E3 ubiquitin protein ligase 2
  ENST ID: ENST00000452031
  CDS Start-End: 221-620
gttcttccgcaccttcctcagggaggtcccgctggccaaggtctggctgtccctcctgtcctctgcccccgcctcccttccaccggtccccgacgtgccgccagctcccagcccagcgtcccgcagggcggtgcgggcagatgccgccgaagcgtctagcgggaagggcgccggcgcggctggagctttgtaggcagccaatcccagagaagcagacgggatggctagttcagcccgggagcacctgctttttgtgaggcgtcgaaatccccagatgcggtacacattgagcccagagaacctccagagccttgccgcccagagctccatgccagagaacatgaccctgcagcgggccaacagcgacaccgacctggtgacttctgagagccgctccagcttaactgccagcatgtacgagtacacgctggggcaagcccagaacctcattatcttctgggacattaaagaggaggtggaccccagtgattggattggactttatcatatagatgagaattctccagccaacttctgggattctaagaacaggggtgtgactggaacacaaaaagggcaaattgtatggagaattgagcctgggccctatttcatggaac

SEQ ID NO: 139990 - DNA, 14739 bp, Homo sapiens
  Payload ID: 7456
  Gene Symbol: HUWE1
  Gene Name: HECT, UBA and WWE domain containing 1, E3 ubiquitin protein ligase
  Uniprot ID: Q7Z6Z7
  ENST ID: ENST00000262854
  CDS Start-End: 404-13528
ggaggctttcgactgagggctagcgaggggagcagggctggagcagggctggagcagggctggagcagggctgaagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacaggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataacccc

SEQ ID NO: 139991 - DNA, 14796 bp, Homo sapiens
  Payload ID: 7456
  Gene Symbol: HUWE1
  Gene Name: HECT, UBA and WWE domain containing 1, E3 ubiquitin protein ligase
  Uniprot ID: Q7Z6Z7
  ENST ID: ENST00000342160
  CDS Start-End: 459-13583
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacaggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 139992 - DNA, 4805 bp, Homo sapiens
  Payload ID: 7456
  Gene Symbol: HUWE1
  Gene Name: HECT, UBA and WWE domain containing 1, E3 ubiquitin protein ligase
  ENST ID: ENST00000426907
  CDS Start-End: 1-3592
gccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacaggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 139993 - DNA, 872 bp, Homo sapiens
  Payload ID: 7456
  Gene Symbol: HUWE1
  Gene Name: HECT, UBA and WWE domain containing 1, E3 ubiquitin protein ligase
  ENST ID: ENST00000446750
  CDS Start-End: 595-872
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttct

SEQ ID NO: 139994 - DNA, 14311 bp, Homo sapiens
  Payload ID: 7456
  Gene Symbol: HUWE1
  Gene Name: HECT, UBA and WWE domain containing 1, E3 ubiquitin protein ligase
  Uniprot ID: Q7Z6Z7
  ENST ID: ENST00000612484
  CDS Start-End: 1-13098
atgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacaggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 139995 - DNA, 729 bp, Homo sapiens
  Payload ID: 7456
  Gene Symbol: HUWE1
  Gene Name: HECT, UBA and WWE domain containing 1, E3 ubiquitin protein ligase
  ENST ID: ENST00000468322
  CDS Start-End: 1-574
cacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattg

SEQ ID NO: 139996 - DNA, 688 bp, Homo sapiens
  Payload ID: 7456
  Gene Symbol: HUWE1
  Gene Name: HECT, UBA and WWE domain containing 1, E3 ubiquitin protein ligase
  ENST ID: ENST00000622887
  CDS Start-End: 1-688
ggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatgttgcagatgtggctatggaaagcagtccaggctcatccatctctatggagcacaggctggatgttgaattaagggcatcaggttccagcagcagcactaacatctcttctggccccagccctggtcccagtcccggccccggcaccggccctggccccggccccggccccggccccggccctggccccggccccggccccggtcctggtcccggccctggccccggccctggccctggcccccgtcctggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatac

SEQ ID NO: 139997 - DNA, 3594 bp, Homo sapiens
  Payload ID: 7457
  Gene Symbol: HHAT
  Gene Name: hedgehog acyltransferase
  Uniprot ID: Q5VTY9
  ENST ID: ENST00000261458
  CDS Start-End: 196-1677
aaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 139998 - DNA, 2714 bp, Homo sapiens
  Payload ID: 7457
  Gene Symbol: HHAT
  Gene Name: hedgehog acyltransferase
  ENST ID: ENST00000367009
  CDS Start-End: 246-797
aaagtagaaaaaccttgtggttcttttggagtgaaagccttgtaataggccccttggggcatgctggggctcatttctagacagtgaggcgtgatgagcaggagagatgaagaaaatctgcttctcttgcaaagtaattccttcatgagacttcattaaaagggtcttcaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 139999 - DNA, 3626 bp, Homo sapiens
  Payload ID: 7457
  Gene Symbol: HHAT
  Gene Name: hedgehog acyltransferase
  Uniprot ID: Q5VTY9
  ENST ID: ENST00000367010
  CDS Start-End: 228-1709
agtgcgcccgggcaaaggcggggatctaggcgccgggacaagtccgcgcacggccctgcccacgtcctctctccttggcttcgtccccagcttccggaactgctgcggggagttgcgaactctggtcctcttggcagtatcggcggtgcgcctgcctgcctgctgtgactccagggactctaaaaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 140000 - DNA, 721 bp, Homo sapiens
  Payload ID: 7457
  Gene Symbol: HHAT
  Gene Name: hedgehog acyltransferase
  ENST ID: ENST00000426968
  CDS Start-End: 99-721
aacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggag

SEQ ID NO: 140001 - DNA, 3575 bp, Homo sapiens
  Payload ID: 7457
  Gene Symbol: HHAT
  Gene Name: hedgehog acyltransferase
  Uniprot ID: Q5VTY9
  ENST ID: ENST00000413764
  CDS Start-End: 177-1658
ctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 140002 - DNA, 3507 bp, Homo sapiens
  Payload ID: 7457
  Gene Symbol: HHAT
  Gene Name: hedgehog acyltransferase
  Uniprot ID: Q5VTY9
  ENST ID: ENST00000545154
  CDS Start-End: 106-1590
acggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 140003 - DNA, 2864 bp, Homo sapiens
  Payload ID: 7457
  Gene Symbol: HHAT
  Gene Name: hedgehog acyltransferase
  ENST ID: ENST00000545781
  CDS Start-End: 284-532
agagacagagggtgcagagaaccccagcggcagggactgaagggaggtgatggctgggagacgggaaaggatgcgaccgactttgagtggagcttctggatggaatgggggaagcagtggctggtgtggcttctccttggccacatggtagtgtctcaaatggccacactgctggcaagaaaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggtgagcaggatccttgctgctgtgttaggggacagtggaactaggcagatcaggtttattagggatggggccatcagattccctgcccccactatgggccctttctactaggttggttcaaagtccatatgcctagaggcaagacagctggaaaagaagcttctgtagtgcatatatgtgtgtttgtgcatgggtgtgtgtgtgtatatataactataaaaaatgtattatgtaaaaattagaacatttaaacaagaaaataacctctcaacagaaaccatgttaagatccattcttctaaattttttccatgtgtatatacaaacagacatatgtatataacattaaaacaaatgctattacagagagatgattgtatcgggaccacctttttaagtcactgagtccatacctaaccaccctttttaatggctacatagaattcccttacgtggatatgccataatttattttagtctcctattattagtaatcatattattctaaagattttttgcaactatcaactgtattaagatgaatatcataaccaggatgaattctcgtaagtgaaatttccaggttcaaggtttttctcatctttaatgttcattatgtatattgcttattaactcttaactgccctgtagacaaaagtacactaatttgtatttctaccaatggtgcataagaatgaccttgctaatactgagtataactggaattttaaatccttgataggtattgtatatagtagtataaaaaacagctaaggtttttaagaagcagttcaactttacaggaaaatgatttggaaaatcaattaagcatttctctttacacatatattttaagtgattttaaactatgggcatagcttttatcttgcgaatgtgatatatgatatattacaatcttgtaggaaatcatcagttctgaagatgtagcaatattcctctaaccccgaaaaaagtagctaaaaagaaatgtgctggcatcagtgttcatggcaggcaatcacacacagaaaatttgaaaaatgattaatgtggctacattccacccagtgtgaataactaaagcaaatgcactttaaaaagccctgtcaaaacagaatacatttacatatgtttttataaagatagccatagtacaagtggacagttatttcaataaaaactgaaataaaccgagtagtcaaacaacacattggaggggatttaaatatgctcatgtatgtataaagataaatatttttccagccatcagcaggaaagaaatgccagtggattctaacagaaaatgttatttcagtgaaagccatggctatgtaacacacaggaaaaccaaaaaggatggtatcataaagattttaatcttcatcctcaaatctgagcattctgctccaaagcctgaaaacacagttaccacctttgaaagtcagaaggttcttttcagcccagtctgtagccctgcaacacatttctgtgctctttcatgaagcaagtaacattaaccttgaacttaatgttaagcagtgctctgtggcctttgagccatagcttatgctagtaataattttagaaatctaaaacattcgagtaacccaactgtgccatgtagcctgtgacctgttcattttggttcaaaataaatcaaggcatcaagcacacttactcacaggatgaagctcttgcttgtctaccttgctccatcacaccttgctccaggactcactcattcacctcacttgaccttccatctacaattcaggtaccttggtacatagtaatttttgatatgcatttttttggcaaaatatttgtcttatatgttgcaagtatgatgtttggcttgcatatttattgagcaagaatatatgaaacttatttttatcacctacaagcctggtaggcagttacagctatttagacgatggactccttgagtacatggccaggttcccattactctgtttatccccattgtctgagtgagcctcagtgttaaatcagtgcacaattagtgctttcatatcaggttgattatttagttcttcctccacttgcccagacatagaatcttcctccagtaccctgtttcttatgtagttccacacaacatccaaatgcacacaattttttgagtaaactatttccccacttaggttacccttcttccctctcttttcatgaatcaatttcctgttcttctgtcaaaatccaaatgaagacttactggctttgtgagttaattatgcatgcccctcacatcctcagtagtattcagagttctccagagaaacagatcaataggatgtgtgtgtattttggtagggggatagggatgacggtaaagaaatttagtatacagaattagaccatgtgattttgtaggctgagaaattcagacccaggagagctgatggtgtaagttccagtcc

SEQ ID NO: 140004 - DNA, 3446 bp, Homo sapiens
  Payload ID: 7457
  Gene Symbol: HHAT
  Gene Name: hedgehog acyltransferase
  Uniprot ID: Q5VTY9
  ENST ID: ENST00000537898
  CDS Start-End: 243-1529
acggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 140005 - DNA, 3164 bp, Homo sapiens
  Payload ID: 7457
  Gene Symbol: HHAT
  Gene Name: hedgehog acyltransferase
  Uniprot ID: Q5VTY9
  ENST ID: ENST00000541565
  CDS Start-End: 177-1247
ctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatctgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggctttagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggaggggatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 140006 - DNA, 1750 bp, Homo sapiens
  Payload ID: 7458
  Gene Symbol: HHATL
  Gene Name: hedgehog acyltransferase-like
  Uniprot ID: Q9HCP6
  ENST ID: ENST00000310417
  CDS Start-End: 148-1662
agggcctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 140007 - DNA, 915 bp, Homo sapiens
  Payload ID: 7458
  Gene Symbol: HHATL
  Gene Name: hedgehog acyltransferase-like
  ENST ID: ENST00000416756
  CDS Start-End: 222-915
agctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcagg

SEQ ID NO: 140008 - DNA, 461 bp, Homo sapiens
  Payload ID: 7458
  Gene Symbol: HHATL
  Gene Name: hedgehog acyltransferase-like
  ENST ID: ENST00000426666
  CDS Start-End: 1-373
cgtcctctttggtgttgtcaacactgtggcatgcctcgaccacctggacccaccccagcctcccaagtgcatcaccgcactctacgtctttgcggaaacgcactttgaccgtggcatcaacgactggctttgcaaggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 140009 - DNA, 996 bp, Homo sapiens
  Payload ID: 7458
  Gene Symbol: HHATL
  Gene Name: hedgehog acyltransferase-like
  ENST ID: ENST00000457462
  CDS Start-End: 214-996
aggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaag

SEQ ID NO: 140010 - DNA, 1865 bp, Homo sapiens
  Payload ID: 7458
  Gene Symbol: HHATL
  Gene Name: hedgehog acyltransferase-like
  Uniprot ID: Q9HCP6
  ENST ID: ENST00000441594
  CDS Start-End: 263-1777
agcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 140011 - DNA, 491 bp, Homo sapiens
  Payload ID: 7458
  Gene Symbol: HHATL
  Gene Name: hedgehog acyltransferase-like
  ENST ID: ENST00000442469
  CDS Start-End: 139-491
agttggaagccggaccccagagcctgaggtgggcagtgtgccagggtcccttgcggcctcctcaaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggta

SEQ ID NO: 140012 - DNA, 487 bp, Homo sapiens
  Payload ID: 7458
  Gene Symbol: HHATL
  Gene Name: hedgehog acyltransferase-like
  ENST ID: ENST00000417472
  CDS Start-End: 139-487
agttggaagccggaccccagagcctgaggtgggcagtgtgccagggtcccttgcggcctcctcaaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagagcgggtttgtaacaggcacttttgatcttcaagaggtgctgtttcatgggggcagcagct

SEQ ID NO: 140013 - DNA, 690 bp, Homo sapiens
  Payload ID: 7458
  Gene Symbol: HHATL
  Gene Name: hedgehog acyltransferase-like
  ENST ID: ENST00000455195
  CDS Start-End: 80-690
cacgcaggtcatgggggccttggcaggagcggttttggcagagggtggggccggtgcctctggaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactcctt

SEQ ID NO: 140014 - DNA, 10072 bp, Homo sapiens
  Payload ID: 7459
  Gene Symbol: HHIP
  Gene Name: hedgehog interacting protein
  Uniprot ID: Q96QV1
  ENST ID: ENST00000296575
  CDS Start-End: 656-2758
tcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacggatgaaaaagcaagaaaacagccaatccttataaaattccagcattaaacatttgtaaagtgcttttcaccatagcaagactgtcagagtctatgttattagaatgttgcagatttccactgaatcgaacctcactggagaagagctcacttgtttttaaaaatcttggctatgtaagctgtcacctgtacaaatttttaacataataattcttgccaaatatgactttaaatgtacgtgttccttcagaactcaatgaaaatactctttggctaatgtatcaataaattttctgtaaatgttctgttcagggttttacagagatgacatgttctgacttaaaactgcaaaaagtctagtagatatttttcttcatggttttcaaagccagctctccacgtttggattttaacaaaatataaggcctctttgcactagtgaaaaaacacgtctactcatgacaagtgcacacccactatggctgtccttcttctgtaaacatccattcctctagaatctaaattgtagagcagtatagattatgcagcgccagctgactttctaaaccttctccttacctttaggaatacaagcctcaatttaaaaaatatattgtagctagtatttctctattgttttaaggtgagagatttgcaattaaagcccagtaagcatttatatagaagccacaatgtagaaagattggttaagtacactgctcttgtcttccatatatgattacttaagtttcaagtgacctcatgccaaatggaaatgggttgagaaatcttggttcagtgcttagtgaacaatagcctgcattaaaaagtgcatgcataattttgcacaatttagattcaattgacagtctattcaaagaagtctcaggattaaatgagcatggagaccaaattgccctcttaccccagaaaaggggtggtcccttctagtcacactaacacttcattggcccaacagtgtgacaaatcttgcaatgaaccatgcagtagcctgcatctgtaggttaatagcaatcttttgtctccattgctttctcttcatagcccttttactgaattccatcacagaaagttttacaattaaaaaaaaatgtcctgacaaccatttttgtaaatggaccttaccatctaattgtcccttattcaacgtgggtgacattaacaaaatgtgaacttcttgtgagggagccagctgtctaaatctgtcaaatcgtgcagttttattacacattctccaattcttcctagtttccctgaaaacaataaggatactgctatatattcagtaaaatctaaaaaaatcaagcattacttcttacatctttaaactttccatctcctccccaaaataaaaggtgttctattgccattagttctactgttttaaaatatctatattaagttgaccaggcccagattttttatacagctttttcccaagtgaaagattttcaagtgacttagaaaaacatatgtgccccaggtgtcattgccttttcttttgtgagtcattagaatgaaaggccaagttcttctcaagagaagatagcaagatccacggatattaagccaagcaaagaaagtaaaatcattggagtcatttctttctgttcttaggagaaaagtagatagcactggctaattgatggcaacatattttaaattaagtggtcaattcaaaaattctctttgaccttttctttcaagtagatttttttaaatgcatgactggagaattatcttcaatgattcatgatgagaggcaggtaggaattggttaagaagtatgagcaggaaaaaattattgtttaatcacatgaaaggcaacatctgttcagttcataaagcacacagtctcgaatggaagaaaaaaaggtccttcgtaagaatactgatgcataagataaagacgaaataatgaaaaagaaaaatgtatattattattcccttgtccattctcaagtttaagctgcggttgtcagttgaatgtgaaatgatgttatagttgttttaaatggttggaaataacctttctactactgtttctgccacactgttgtcctggttcatagaaccttgttttcttgacagttatttaaggtaataaaaggaacacaatttggcagatctttaagtgaaagagagaaaaaatttaagaaattgagtgatggctaaaagtaagtgcttccatccataacttttcttcttggatttttttcaatgtaattattgtaaaatatatttttttattttatcatgaagaatactcggaaggtttctcagattaatgagtatctcataaagagtagagaaaccaacacatacaatatatacacacaacctaaatagaaaactattttctttgtcatttgcatgccccagagaagttacttcttccctatttatttctttgaaaataattacaaaatagtatactaacaattttaatccatttgctgttttttttttttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaccatgcccagcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgttacctatactgtcagtgttcacctcctctccctccctccttctctctctctctccccctctcgctctctcggctaatatatatgtgtatgtgtatatatatatgtatgtatatatatacacacacacacacacatacatacatacatacatatattctttttccttttaaccacttccctctcctacattttctattggttttgcctaaatagacatgttctcaatacacccatgttgaaggtatcctgggctagattgctgttgattttgctggttatgatcttttctttgtttttctgaaaaatagcctctcttgattccacattttctcaaattctatataacaaataatagtggatagtaaacaaatgacatactaggctgatctattacaatcattgaaagaaataaggaagagcagaaatcactaacagtccagaggctccaattcagctgctctagcatagatacaggaaagacatggagaataacactggggttagctaacagcagggaaagttagtagctatttcctagccaaggaacaaccttctctatggaataattttaagaaaattattccaaatctgtgaggaaaaaataagaagcagttcctcaatggagactttataaatcttaatttcctcacccctgggatgagatttgaagttgcagaggactcagaccaaagtcccatggcagaaaatgtacatatttttaaactactcccaggaagtaaactagtactgtgaatgctggcaataccatcagaaagtttatctttaaaatacctaaaaataaatatatatttgctatcttatcctctttttgtcacacaaacataaattggtcatatatatatttatatatatggttatatatatttggttatatatatatctttatatatatatcttatatatatatctttttatatatatcttatatatatatctttttatatatatcttatatatatatctttatatatatcttatatatatatcttatacatataagatatatgtatatatatatacattatatatatataatatatatatattatatatatataatatatatcttatatatatatatatcttaatacatatatataaccatggaacctgccaaacactaatcctagccaacttcaatccttctttctcttaactatcttctctgaataagttctggacttcaccttaaaataagtttttaggagagtaatatatattcatgggattgtgagggagcattgtagagctgttttcttctcagtcatagtggtggttttcctagctgctatggaaaggtttgttcacttatgagattaggacttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactagggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttga

SEQ ID NO: 140015 - DNA, 1770 bp, Homo sapiens
  Payload ID: 7459
  Gene Symbol: HHIP
  Gene Name: hedgehog interacting protein
  Uniprot ID: Q96QV1
  ENST ID: ENST00000434550
  CDS Start-End: 505-1467
gaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaattttatttatttttgtgctggctacgttaattttattttagtgttaccttcctcactgaaggtatttctttgtaataaaagaaagaatcttgcaggagaaaataagggggcaacataagaaacaataattatggcacctgaattaggacagtgacattaaatttctgttatttgttgactattgtgcgctgcaatcgaattgatatttgacatgctttccccatgtaattgacacatttaaaggaatctttggctttataaagtattgtttaaatattgtttaatgggcataacacaggactgtacatcagcatttgctagtagaaacaaagaggtcttttggttattttggcaattgcaaatcattctttcaccatctctgtttttgagtctgtctcataaaaaatactacttatactac

SEQ ID NO: 140016 - DNA, 12866 bp, Homo sapiens
  Payload ID: 7460
  Gene Symbol: HELB
  Gene Name: helicase (DNA) B
  Uniprot ID: Q8NG08
  ENST ID: ENST00000247815
  CDS Start-End: 60-3323
catgaccatgcagttagccagggttttcccgagttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtcaattatagcttctattcatggactcaaacaatgatgaccacaaacaaaccatggaaattttcttcggttagagttctggttgtggatgaagggagtttggtatctgtaggaatcttcaaatcggtcttaaatttattgtgtgagcactccaaactttctaagcttattatccttggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataactggagttttaaggtatttgtgttagcaaatgttttaaatccatttcatcaaagtattaatgatttcaacacgtcatcatgagaactggtagcactggacataagtgaagagattagatattttatatacatatatatttttatacaattatgtacattaagccaggcacggtggctcatgcctgtaatcccagcactttgggaggctgaggcaggtggatcaccagaggccaggagtttgagaccagcctgaccaacatggtgaaaccccatctctactaaaaatgcaaaaattatatgggtgtggtagcacatgcctgtaatctcagctactcaggaggctgaggcaggagaatcgcttgaacccgggaggcggaggttgcagtgagctgagattgcaccattgcactccatcctgggtggcagagcgagactccgtctccaaaaaaaaaacaaacaaacaaacaaacaaaaaaaaacaaacaattatgtacattaaaacattgtatttttaggataatgcctcgtaactttgatgatcgttgtgtgttacctttgccaatgggttgaagcagtggcaaagaaaaggtgtaattacatctgttgatgttattgacatgcctcctaggatgttgaaatgtggtcattttacaagactgctgctcacttcatcactgctgcctggggcccagcctacctgggacttttccttggaagtgctttctgagttgggagcacattgttttgaatatgttccacttaggaaggttttttctctctcagaatgatttgatttttaaatttttatttatgttaaatggtaaaagaaaaagtcaagatgaaaaatatatctgttaacccatttatgcctagtggtccattattgggacactaaacatgtgagagttatttatatcccactgctcaaagtcctcaccaacgtctgattgcaaaaattcagaaagttgcaacctcaggcataaatggttaatagctttattgagatataattcacatacatttcacccattttaagtatataattcagtggcttttagtatattcatcaaattggacaactaccattattatcaattttagaacttttttttttttttaatgatagagacaaggtctcactatgtttcccaggttggtctcgaactcctgagctcaagtgatcctcccaccttggcctcccaaagtgttaggattacaagtgtgagccagtgtgcccaacctggaacattttcataccctacaaagaaacctcacactctggccgggcgtggtggctcatgcctgtaatcccagcactttgggaggctgaggtgagcagatcacctgaggtcgggagttcgagaccagcctgaccaacatggagaaaccccgtctctactaaaaatacaaaattagctgggaatggtggcgcatgcctgtaatcccagctacttgggaggctgaggcatgagaatcgcttgaacccaggaggtggaggttgcggtgagctgagtcacgccattgcactccagcccggacaataagagcaaaactccgtctcaaaaaaaagagaaacctcacactccttagcagtaatcccctgacttcccccatccctaggtaacctgatttacctagtcccaatagacttgcctattgcagacatgtggttctttgttccggacttatttgactagcataatgttttcagactccatccgtgttgtaccagtgatgtgtcagtgcttcgtctcttttattgccaaataatatcccagtatatggataaaggatattgaatttgtccattcatcagttgatggacatttatttgggttatttcctaatttttggctattatgaaatgctgctatgaacatctgtgtataagtttttatgtggacatatgctttcacttcttttgggtatataactaggagtagaattgatgggtcatatggtaactctatgtttaacattttgaggcactgccagactttttccaaactagctgcaccaatttatattctcaccagcagtgtatgagagttccagtttctccctattctctccaacgtttattattatctgacttcttgattatagccatcctagtgggtatgaagtagtatttcattgtggttttgatttgcatttttcttatggctagtgatgttaaatagctttcgtgtgactattggccatttgtatgtcccctagagaaatgtatattcagatcttttgcacagttttaaattggatattttttctttctgtcactgaaatctgtattagtgagggttctccagagggatggaaccaataggatatatgtggatataaaagggactttattagtgtattagttagggtaccctagagggatacaactaataggatatatatatgtggggggggggcggggagtttattaagtattaacttacatgatcacaaggtcccacaataggttgtctgcaagcctgaggagcaaggatagccagttggagtctcagaactgaagaacttggagtctgatgtttaagggcagaaagcatccagcacaggagaaggatgtaggctgggagcctaggccagtctcgccttttcatgtttttctgcctgctttatatttgctggcagctggttagattgtgcccaccagattaagggtggttctgccctccccagcccactgactcaaatgttaatctcctttggcaacaccctcacagacacacccaggatcaacactttgcatccttcaatccaatcaagttgacactcagtattaaccatcacaataagagagaattggctcacacgattataaagcaaagtcccacgataggccatctgcaagctggggaaggagagaagctgatagcatggctcagtccaagtctgaaagcctcaaaaccagggacgctgacagtgcagccctcagtctgaggccaaaggcccaggagcctctgggaagcaattggtgcaagtcccagagtccaaaggtggaaaaacctggagtctggtgtccaagggcagaaggagaggaagtcaagcattctgcacagcacaggaagaaagagagggagcagactcagcaagcacgctgcttatctccattcgtccacctgctgtgttctagcctcactggcagccaactcgatggtgcccacccacactgagggtgggtcttcctctcccactccactgactccaatgtcagtctctgtcagcaacaccctcacagacacacaggggaacaatgcttcatcagccatccaggtatctctcaatctagttgacacctaatattaaccatcacaaaatgtaagaattctttacattttcaacatttaagtccattatcagaaacataatttgcaaaattttcctcccattctgtgaattttattttaattaacctgatagtatctgatatggtttggctctctgtccccacccaaatctcatctcacattgtaatacctatgtgttgaggaaggatcctggtgggaggtgattggatcatgggggtggtttcccccacgctgttctggtgatggtgagttctcatgatagctggtggttttaaagtatggcactcctgccccaacccccttctgccaccttgtaaagaaggtgcttgcttctcctttaccttttgccatgattgtggttttctgaggcctccccagccatgtggaactgtgagtcaattaaacctcttttctttataaattactcagtctcaggtgtgaaaatggactactaagtgtcctttgaggcccaagttttaaattctgatgatgaccagtgtatctgtttttgttgttgctgctgcttgtgcttttggtgttatatccaagaaactattgcctatccaaagtcatgatgatttactacaattttttcttctaataatttacaagttttggctcttatacttagatctttgattcacttttagttaatttttgtatatggtgtgaggtagggatcccacattattcctttgcatgtgacaattcaattgttcagctccatttattgaagagattattctttccccattgaattatcttggtacccttctcaaaaattagttgactgtaaatgtgagggtgtatttatggattttaaattctattcaattgattcatgcatcttttttttttttttttttcttcttcgagacggagtcttgccctgttgcctaggctggagtgtggtggctcgatctcagctcactgcaagttccgcctctcaggttcatgccattctcctgcctcagcctcccaagtagctgggactacaggcgcccaccaccatgcctggctaatttttttttgtatttttagtagagacggggtttcgccgtgttagccagaatggtctcgatctcctgaccttgtgatctgcccaccttggcctcccaaagtgctgggattacaggcatgagccactgtgcccagcccgattcatgcctcttttttctttttcttttttttttgagatggagtcttactctgtcacccaggctggagtgcaatggtgccatctcagctcactgcaaccaccacctccttgtttcaagcaattctcatgcctcaccctcccgagtagcaggcattacaggtgcttgccaccacgcctggctgattttttgtatttttagtagagacggggtttcaccatgttggccaggctggtctcaaactcctgacctcagatgatccgcttaccttggcctcccaaagtgctggcattatagtcatgagccactgcgcccggcccatatgtctattctaatgccagcaccatattgtctttattattgtagctttgtagaaagttttgaaattaagaagtgtgagtccttcaactttgttcttctttttcaagtttgttttggctattatgggtccctacatttccatatgaattttaggatctacttgtcagtttctgcaaagaagcaaactggaattttgttcaggagtgtgttaaacctacagatttgggaactattgccattttaacagtattaaatcttctgactcatgaacacagatgtctttccatttgcttaggaaagacaggctggagtgcagtggtgcaatcacagctcactgcagcctctacctctcaggctcaagcagtccaacctctttaaccaccccacctcaaccactcttgtagctgtgactacaggcctgcaccacctcacctggctaacttttgtattttttgcagagataggggttcaccatggtgcccaggctggtctcgaactcctggactcaggcagtctgcccacctcgacctcccaaagtgctgggattacaggtgtgagccatcatgcttggttcttctttaattctttgtagttttcagagtataagttttgtatttcttttattaaatttacaatgctctttgttaaatttatttcaaaatatttaattttttatcctgttgtaaatggattttcttaatttattttggttcattactgctactgtatagaaatgcagtcgatttttatatattgatcttgtatcttccaaccttgctgcacttgtttattagttacagtgggtttttagtggattccttaggattttctatataagtgatcatatcatctgcaaatagagatgcttttagtgcttcctttttcatctgtaggcctttaatttcattttcttgctaattgccctggttagagcccctagtatattgttgaatagaagtggcaagagtgaatatccttgtcttgttcatcatattagggagaaagcattaaatctgccaccattaactgtgtttgctgtggatctttcttttaagtcctttattgagatgaagaaattctcttttgttcctaggttgttgtgtatgaagggacattgaatttcgtcaaatcctttctctatgtattgagatcattgtgtagttttgtcctttattgatgcagtgtggtaatttttggatgttaaatcaatcttgtgtccctggagtaaatctcacttggtcatagtatacaatcctttgtatgtgctgctggatttggcttgctggttttttgttggggacttttgcatctaaattcatgaaagatattggtctgtagtttctttttcttgtgatgcctttgtttggttttggtatcagagtaatagtgaccacatagaatgagttgtgaagtgtccccttgtcttctattttggaagagtttgtgaagaattggtattaactcttctttaaattaatctggccctgggcttttctttgtggggagtttttgttttgttttgtttttgttttttgagatggagtttcgctcttgttgtccaggctggagtgcaatggcacgatctcggctcaccccaacctccacctcccaggttcaagcgattctcctgcctcagcctcccaagtagctgggattatatgcatgtgctaccatgcccagctaattttgtatttttaatagagacagggtttctccacgttggtcaggctggtctcaaactcccaaactcaagtgatccacctgcctcagcctcccaaagtgctgggattacaagcatgagccactgcacccggcatgggaagttttaaagctactgattaaatttctttacttgttataggtgtatttagcttttctatttcttcttgagtcagttttgacagtttttctctagaaatttgctcatttaatctatattttttaattttctgacatacagttgatcatagtattcctttatggttttttaaatttctgtaaggctggtagtaaagcctctgtttcattcctgattttagtaatttgagtctctttttttcttggtttagctaaaagtttatgaattttaatctttttaaaggaccaacttttggtttcattgattttctttactgtcttcctattctctatttcattaattttaactcttgtcctattacttttaggagggcctcttaaggaggggtcgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgatgggcaggggggttactacaaccttatagaaataaaatttctttaactctgcctatatttcagggtatagtcctcaggtaaagcttcacattgtcaagaagaacttgaaaataccttttttccataaaaacacaatgaaactaatactatgtaacggaatattccaaagcactagttcttataaataactattggccaaaatacaaataactgacccaattcaaaattctctaagatttcattaagatccttttgtagttcataagcctgatgcatgggtgttcacacgcatgtgtgagatgtgcctccctcaaaccttgttatggcgccagcccattaccggtctgtcatgaaaaaaaaaatatttcagtaaaagaggatacttctagtatcctttttaaaatttgaattggaagcaaatagtatttcatcccagcatgttaaaattgcaagggtcacctaccccagcttaccatttgctaaacacgcatcagtcaccagtggaacacacatttccaatgctaaaggtcttgactgcttggtgaaaaccactttgcaacactggtgttggaaattactttcttatattaagctgaaatctacctcattggaacctctgctcataagtcctgagtctcatgtagttcagaccttgtctcttctgccccatctggctacttatctccagtttctcctgccagtcttccggtggcatagccccaaaccctttcatttcatagtttgtcactgccctttttaagaggactggggtgctcagaacttattggctgaccctagctcttcctttggcctggtcactatatttgaaaagtgctacctgaaatcataagagcttttttgttttgtttttaacagccattttctattgttgattcattttagttttggttacaactgaaatatctgtctttcacatgaaatatagcttctcatttgcctttcttcacaaagtctgttctaactacacatttccttggcttcagcctcatgcttgatgcagaagtgaggagagtgcaataaaaatttgaacagttgcttggatttttgcaataatagattgtcagttggggtcatatgactctcaggtgctagaaaatactctgcctttcagaacgtaaccgtgggcacactgaatgcaactgtataaaaatgaatgtgaatttttaaaggtagcataattaaagtttgtacattttaacagtttatgtaaatctgtctcatagaatacatgtaattttctctgaggtggatgttgtgatacttgatcaatatttgtcacctacagtaaatgtaccattggtcttggaggtatttctgtgtgtgtttttagcccattctcatatatttcactcctcatcttccgaatgatcctgtggtacagacatgaccttcagtttcaggtagagaagctgactcgtggtgactaaatgtcatactaccaataagtactggagcctgaaatcaaacctggactcaatttcaatacacaggttcctactcttcagtggtgcttctcaggttgataggaaaacctctcacctttagaaaattatacaaaaataaacattgtggccggatgcggtggctcacgcctgtaatcccagcactttgggaggccaaggcgggtggatcacttgaggtcacgaggagtttgagaccagcctggccaacatggtgaaaccccatgtctactaaaaaaatacaaaaactagccaggtgtggtggcgggtgcctgtaatcccagatacttgggaaactgaggtaggagaatcacttgagccccggaggcaggggttgcagtgagctgagattgtgccactgcactccagcctgggcaacagagtgaaactccatcatcatctcaaaacaaaacaaaacaaaaaaaaattgtgtaggactcaggctagaacattgaaatatattcaaaacaacaccaataatgcatatcctctttatttggctttttaaaatcactgtttattccatttggtagagggttttatttttttccatacaaatatttgaacaattttgaattccccaaaaccatacatagacgataaataccatgctattaaagtattaaatttgtacaaaaatactttacagtttaatacttgtttgttacaaataaaaatacatatttaagtga

SEQ ID NO: 140017 - DNA, 3167 bp, Homo sapiens
  Payload ID: 7460
  Gene Symbol: HELB
  Gene Name: helicase (DNA) B
  Uniprot ID: Q8NG08
  ENST ID: ENST00000440906
  CDS Start-End: 26-1750
tgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaaca

SEQ ID NO: 140018 - DNA, 3432 bp, Homo sapiens
  Payload ID: 7460
  Gene Symbol: HELB
  Gene Name: helicase (DNA) B
  ENST ID: ENST00000542394
  CDS Start-End: 26-2566
tgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtcaattatagcttctattcatggactcaaacaatgatgaccacaaacaaaccatggaaattttcttcggttagagttctggttgtggatgaagggagtttggtatctgtaggaatcttcaaatcggtcttaaatttattgtgtgagcactccaaactttctaagcttattatccttggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatatagaatatctttgaacgtatttgaacgtagaacatatttgaaggtatgcaaaatagttctttggtttggtgacaggatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtca

SEQ ID NO: 140019 - DNA, 3586 bp, Homo sapiens
  Payload ID: 7460
  Gene Symbol: HELB
  Gene Name: helicase (DNA) B
  Uniprot ID: Q8NG08
  ENST ID: ENST00000545134
  CDS Start-End: 25-3288
gtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtcaattatagcttctattcatggactcaaacaatgatgaccacaaacaaaccatggaaattttcttcggttagagttctggttgtggatgaagggagtttggtatctgtaggaatcttcaaatcggtcttaaatttattgtgtgagcactccaaactttctaagcttattatccttggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataactggagttttaagagataggggttcaccatggtgcccaggctggtctcgaactcctggactcaggcagtctgcccacctcgacctcccaaagtgctgggattacaggtgtgagccatcatgcttggttcttctttaattctttgtagttttcagagtataagttttgtatttcttttattaaatttacaatgctctttgtt

SEQ ID NO: 140020 - DNA, 13810 bp, Homo sapiens
  Payload ID: 7461
  Gene Symbol: HELZ
  Gene Name: helicase with zinc finger
  Uniprot ID: P42694
  ENST ID: ENST00000358691
  CDS Start-End: 168-5996
caagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgctccatacccacaccatcaccatcctcacctccagcatcttcctcagccgcccctgggattacatcagccgccagtgagggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagtttgtctaaaatgtatttaaaaagaaaaaaaaattgtaagtagcatttacatttattcaataatattaccacatgctgggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatccaaaggaagatgtttaccctcttgaaacttatggtcttgtcacacatttaaagcaatatatgtccttattttcctgaccttgtaatactacttttatatttcagaggtatctcgaaactacaatataaacttttaaaaaaaaataagatgaggctggggaacctttcgaatgaacccaatcttcctgatgatccattcaaaaacaggtttttggaagaccactttcgataggcaatcctataatcaaagtacatttttaaaatcaggttgtaaaatggcaaaggtaaagaaaaattactgacatttcttctatgattggagtttagtttatgttggccagctacaaccccttttaatcctcagacagtttgggataaaagagtgcctttggttaatggttagcaagctccaggataagcgctgcgtgcctcttgtattcagctctacctttctgctaagagtgcggttcatttgtgtgtggctttgcgttccaggctgtgggtctctgtgtaaggtggcagacatagacttgtaaactgcagacgtgttaatggttagcataaatcacagctggaaaactgagccggcaagttacagcaccactctttctctgtatgatgtcagatcaccacatttagcaatgtcaaattttactcaacattctttagtaggaagaaaagaagaaaaagttttgccacgtagctatgtgcttttaagtctgtgacaaaactcaagacatatccgaatgaaaattagatctctctgatgtgaggatgttatggaaaataattttcccatcagtgattatccaccccccagcccccatatacaggactacaacgcaagctagataaatgttcaaaagcaatctgataatatgaagacagaattgtcaagtcagggctttcagttgaccccttgtcatgaggttattgcctaattttctgttttctatacttgaatctttaaaaaatatcagtttttaaattatttatatttatatttagttaagggtcatggggtcgtgtatgcaccccatcaccttatataaatatgttgatgatggaagctttggataaggaagctattaagttgtcatgacatccttgttctaagcagttatttctaaaaactaaaaataatagctacttattggcccaccgctctgctgtgagtatatgagtacttctcattccttatttccatagccagtcaaggattctaacgctgcttccatctgatactcttcttagattctgcatcaaatgcttattttgacttacaacaagcttactcttcctcagcattacataatgccatctttccaaccatgctttaaagaacctgctctttacgcatagtatcttataacattttgaacacgtcttgtgtaagaatcattgcaagtttccatcaaaatgaggcgtgtcttctgagtacagctgatgttctttgggtattacttgagtagtagtagcaagtacccataaatcagatttatgaaacataacttatatgctaggttcaacccttatatatgcatatatatgtatagtatatgtatataaaatttttttccagaaaacttgatgatagctctcagataataccaagtattaccagcttccatttcttcagagcagatttttttctaagtgaggttaattgttcacataatgtctttttacatctttgtcctttgtatcactctgaagttttctttttcttgccagaatatttgtttcactttttaatttcagtgctacttgagattttctttttttttaacctgaaagacgatattttggatgatagagtttgtaaagtgagccttcatgctgaaaaaattcttttcatgatctaaaaatggtcttttgttacgatttgaagaacctcattccgtgtaacatggatattttcttgtgtgtctttaaagggggttttggttgtcatttgggcatatgctttgccaaattgttatagcagaactttgtttttgattaatcagtagttaattattgaccatttaaactaacatgaccttaattttcctttcctcacacagatgtgctttctatccaggtcattttttacacgtgaaataacaaactgctttgtgtagattttttttttttttaaatcatcagattttagaataagtttaggtttaatgtaaacatcaactggtcttttcagttcagagaactgcagaataagtaaaataagcagaattcccactgaataagcattacctaattaaacatagcaacatctaagaccaatttatgaaaatactctccttttttatggaggcattggagctgctgagaaagctaatgaatttcccaactttgggataattaatatatagtattgtgttgctctagtgtagttgattttatgtgtttaatatttttcatgtcaagagcaaagctgcagacgtaaaagatgtttctctagcccccttagctagagcgagccacctttgttaagagtcagggtgtgaagaacaatttcaagataaattttagtatttcaaccattgttattaagaaaattagacttactgaaatactcatttaaaaacagacaccttctatagcattgttttatagtggagttatttttaaaaagggaatcccagaaagaatctataaaaatacaaggttaaaactttaaatgtattgaaagatacaaattggtgctttcaaatgtcatgtaagctagccattgtgtttttttttttccctccagctcctcaatggtagtaatttgtcttttatgatttaccgtacattatttcttgctcaccatccccttaacatatgaaaatccttaatttctactgccgcgctatatgtcttcctgaatctcaaggtataaatgtcttaatggatctgatttgtctccactctttgccatctgatccacattcaaaccgcctagaaattagaaagaataggtaatgttctatctacgatttcttgttcaaaatatcacgtagtggtgccaatcacttacaaagacaccatctccatcttgaaagagtaactggcatgttagtcttgaaaatgctcattatgatatgctcctcacatttcccatctgcttgaggatggacatttattagctgagactttaaagctgctaaattcacactttctactttcatacctttttaatcagtaatgtcaagaccattgttgcaaggagtgaatcttactaaacacatcctgttattactttaaactagaatatgagattcaagagatttaaaaacaattttaatgtaacgtttaaaatttttgaaccaattgagaatgtctactttggagtgaagtttaaggaaacagtcaccagagtttctaaaaattttttggagggaggtacctaatagaagaatctagacttagaaatgtgaactgtggttaaataccaaacccagttccgcagtggtcgtctaaagcgtctaaaactggagtgttaagaaaacccagagacattcatatagtttcagttatcagagtattagaccagactttatttgcaatttgttcaacagagagattttattttgatacagatattaagcataaagcatagtaagttttatataattctatgagttcattaaacaatattatgaaattttcattatgttcgtggggagtctttttaactgtttctacctcatatatgaggtctcttctgtattttactttgcatactagcatgtgattgcctgccttagaactatgtagaggaggggaaatcgatattaccttttaagaaatttttgattttatgaagtgttttcattaatacttttttaatgtttgagaagtaaaggggaaagggtggcaaattacataggttgcaacacagagtagaagtcacatagtactatttacagatctgtcctgttttaagatttgagaattgtgaacaggatggagcaatggttctcaaacttcagccagtatcagaattgcctcgaggtcttgttaaaattcagatagctggacccacccccagcatttctgattttggtctggagcctgatgatttgcatttccaacaagtttccaggcgatgctgatgctgccagtccaggaaccacactttgaaaatcactgggtctgattctcgcagtttgaaagtctcagagaccttcagagtctgaacgtcttttcaaccatgtatttatttactcagtgtaaaaaactgatctctggagacatttttataaatctggtgccatgactggaacatttgtggagaaaggtctccatggagcgacaggccctttggattggccaccacccctcctcactctcacccctgctggggtctgcactgctcttccgcagtagggtgaaggagctctttggttttagggtgagtttgcttttgtgtacgctgctgcctggacatcagtctggaagctgtgcatttgtttggtgtgcttagggtcaatcttgatccacatgcatggaagtgagaatcctggaaagaagccatcagaatgccatgagagtgcacctagcatgtatcgaggcactaagtgcaggagtccctgtcctaagatggcagtgacatggagcatcgaaaaccacagataatccttaaataataaaataatagttttgtttttttttcttcggggcagagtctcgctctgttgccctggctggagtacagtggcatgatctcggctcactgcaacctccgcctcccggcttcaagtgattctcctgcctcagcctcccaagtagttgggactacaggcatgcgccaccacgcccagctaatttttgtattttttagtagagacggggtttcaccgtgttggccaggatggtctccatctcttgacctcatgatctgcccgcctcgggctcccaaagtgttgggattacaggcatgagccactgcgcctggcaaatgttttagtttttatggttattattattttttttttttgtgggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaatgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttgga

SEQ ID NO: 140021 - DNA, 1872 bp, Homo sapiens
  Payload ID: 7461
  Gene Symbol: HELZ
  Gene Name: helicase with zinc finger
  ENST ID: ENST00000417253
  CDS Start-End: 172-1872
ttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatata

SEQ ID NO: 140022 - DNA, 583 bp, Homo sapiens
  Payload ID: 7461
  Gene Symbol: HELZ
  Gene Name: helicase with zinc finger
  ENST ID: ENST00000579861
  CDS Start-End: 387-583
gtgctcttctttctctagctagtctaagtgacttattttccagataaggaaatataggcctgaagaaattaaatgagttgctcaaggtcacacagctcagtagtagcaacattaaaccaagcttgtttttaatctttggaggcttatctcaagactcttggtctagtgctggtcatgctacattttattgaactagtgtggaccaaaagaccatatgctgggaatattggatacaaatgctttggaactgatatcttggtgaatggtgttttctactatgtattaaaaaaactttcttctttgtctttcagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctc

SEQ ID NO: 140023 - DNA, 617 bp, Homo sapiens
  Payload ID: 7461
  Gene Symbol: HELZ
  Gene Name: helicase with zinc finger
  ENST ID: ENST00000581159
  CDS Start-End: 307-617
gcagccggcgccccggattacctgccccggagtcacagtccgcagcccggacgctcccagggtggctccgcggagcctggagccacattcctaggggaggggtccccacctagagggtcgcggatcacgttacccgcccggaggaggagaccgcgggacacagagtaaacaaggggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagct

SEQ ID NO: 140024 - DNA, 6365 bp, Homo sapiens
  Payload ID: 7461
  Gene Symbol: HELZ
  Gene Name: helicase with zinc finger
  Uniprot ID: P42694
  ENST ID: ENST00000579953
  CDS Start-End: 55-3546
ggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactagcaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggtaaagcctctgttaatgaaattgaagaggttaaagggagaaaacttcgcagaagtgccaaaggtttattgggatgcaagttactttaagtgttggaattgaaggttacatttggcggcaagcggtttctgcaaggagcttgtttagtgtggacatgggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgctccatacccacaccatcaccatcctcacctccagcatcttcctcagccgcccctgggattacatcagccgccagtgagggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaa

SEQ ID NO: 140025 - DNA, 577 bp, Homo sapiens
  Payload ID: 7461
  Gene Symbol: HELZ
  Gene Name: helicase with zinc finger
  ENST ID: ENST00000578783
  CDS Start-End: 1-577
ttttcgccaaaccatagttttcgactttggattggaaccagtactcatgcaaagagtaatgattgatgcagcttctacagaagttttcttttttaggtatatgtatgtttcactcaatagaaaagtaatacgcactacatatagagtgagccaacccagtgctcagagtttatgttactatggatttcatcttgtgctggtattgtgctactttttttcccctgatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatgga

SEQ ID NO: 140026 - DNA, 6279 bp, Homo sapiens
  Payload ID: 7461
  Gene Symbol: HELZ
  Gene Name: helicase with zinc finger
  ENST ID: ENST00000580168
  CDS Start-End: 168-5999
caagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactagcaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgctccatacccacaccatcaccatcctcacctccagcatcttcctcagccgcccctgggattacatcagccgccagtgagggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagcca

SEQ ID NO: 140027 - DNA, 7827 bp, Homo sapiens
  Payload ID: 7462
  Gene Symbol: HELZ2
  Gene Name: helicase with zinc finger 2, transcriptional coactivator
  Uniprot ID: Q9BYK8
  ENST ID: ENST00000427522
  CDS Start-End: 425-6667
gtttttcgtttttatagaaacacagatctttgtcctaaccacaaggttcccctttggtttatgtggtttcctctggttcctgccaccaccacctccccaggccggggccttcccatccctgcccagtggggagtgggaggaagagcctgggacagtggccatacgtcccgggctgatttctggattgggggttctggggaccagggaggtgcaggtgtctgcagtgtcagaggagccgctgggctcgcccaggtgttgcctgaagccctccgtggcctcttgccccttggactcctgacaggagggacaccagtgtttgctgctcacctctgacagccagacaagggctgtgctcaggggcagctcggctgggcacacagtaggtgctttagcggacagcactgaggcccccagcaagaagcccatgagctcctccccctcccgcagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctatgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcagcccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacactgtcgccaggcccgagtccctgcagcaggcccggctgtacgagaacctgcccccggctgcgctacggaagctgctgcacgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgcaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcttctca

SEQ ID NO: 140028 - DNA, 8064 bp, Homo sapiens
  Payload ID: 7462
  Gene Symbol: HELZ2
  Gene Name: helicase with zinc finger 2, transcriptional coactivator
  Uniprot ID: Q9BYK8
  ENST ID: ENST00000467148
  CDS Start-End: 71-8020
gtttgtggggcgtgggcagccgtgctggcgtggggagtcccgctgccagtttgcacacagcgccgtggagatggctgtgtgggaggccgagcagctgggtggcctccagcggggggacctgctcacaccccctgcccctgatggcgacgggcgcacggccccccttggccagccccctggggcccagctgtactgcccggcctgcttggtcacctgccactctcaggaggccttcgagaaccactgcgcatcctcggagcacgcacagatggtggccttcgaccaggccctgccctgggagcaccgttccccacccccgggactctccaagttcgagctctgcccaaagcctgacctctgtgagtatggggacgcctgcaccaaggcacactcagcacaggagctgcaggagtgggtccggcgcacgcaggctgtggagctgcgggggcaggcggcctggcaggacgggctggtgccctaccaggagcggctgctggccgagtaccagcgcagcagcagtgaggtccttgtgctggcagagacccttgatggagtgcgtgtcacctgcaaccagcccctgatgtaccaggcccaggagaggaagacccagtacagctggacgtttgccgtccactctgaggagcccctgctacacgtggccctgctgaagcaggagccaggagccgacttctctctggtggctcccggcctcccgccaggccggctctacgcacggggtgagcgcttccgtgtgcccagctccactgccgacttccaggtgggagtgcgtgtgcaggctgcctcgttcggcacctttgagcaatgggtggtcttcgactttggccgccggccggtgctgctacaaaagctggggctgcagctgggccaggggcgtcgcccaggaccctgcaggaatctggcgctcggccaccctgaggagatggagcgctggcacactggcaaccgccacgtggtgcctggcgtggagcggacggccgagcagacggccctgatggccaagtacaagggccctgccctggccctggagttcaaccgcagcagcgtggcctcgggccccatctcaccaaccaactatcggcagaggatgcaccagtttctctatgaggaggaggcggctcagcagcagctggtggccaagctgaccctgcggggccaggtgttcctgaagacggcattgcagacgccagcgctgaacatgctcttcgcgcctccgggagcactgtacgcagaggtccccgtcccctcctccctgatgccagacacagaccagggcttcctgctgggccgggcggtcagcacagccctggtggcccctgtacctgcacccgacaatacggtgttcgaggtgcggctggagaggcgggccagctcagagcaggcgctgtggctgctgcttccggcccgctgctgcttggccctggggctgcagcctgaggcccgcctggtcctggaggtgcagttccagattgacccgatgaccttccgcctctggcaccaggcagtggacacactgcctgaggagcagctggtggtgcccgacttgcccacctgcgccctgcccagaccttggtctgtcccacccttgcggcgtggcaaccgcaagcaggagctggccgtggcgctcatcgcgggctggggccctggggatgggaggcgtgtccccccgctactcatctatggcccctttggcaccggcaagacctacacgctggccatggcctccctggaggtcatccggaggcctgaaaccaaggtgctcatctgcacacacaccaacagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctatgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcagcccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacactgtcgccaggcccgagtccctgcagcaggcccggctgtacgagaacctgcccccggctgcgctacggaagctgctgcacgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagt

SEQ ID NO: 140029 - DNA, 2740 bp, Homo sapiens
  Payload ID: 7463
  Gene Symbol: HELLS
  Gene Name: helicase, lymphoid-specific
  ENST ID: ENST00000239026
  CDS Start-End: 120-2264
aaaaagaaaaaaaaaacctttaaagaacagaagaagaaataagactttcaaagagaacttaaattttaaaagttaaaaatggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 140030 - DNA, 3099 bp, Homo sapiens
  Payload ID: 7463
  Gene Symbol: HELLS
  Gene Name: helicase, lymphoid-specific
  Uniprot ID: Q9NRZ9
  ENST ID: ENST00000348459
  CDS Start-End: 106-2622
ggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatga

SEQ ID NO: 140031 - DNA, 4987 bp, Homo sapiens
  Payload ID: 7463
  Gene Symbol: HELLS
  Gene Name: helicase, lymphoid-specific
  ENST ID: ENST00000371327
  CDS Start-End: 1-933
atgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattagagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 140032 - DNA, 2675 bp, Homo sapiens
  Payload ID: 7463
  Gene Symbol: HELLS
  Gene Name: helicase, lymphoid-specific
  ENST ID: ENST00000371332
  CDS Start-End: 97-2199
aaaaagaaaaaaaaaacctttaaagaacagaagaagaaataagactttcaaagagaacttaaattttaaaagttaaaaatggtaaaaattcaattgatgcaagtgaagagaagccaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 140033 - DNA, 3131 bp, Homo sapiens
  Payload ID: 7463
  Gene Symbol: HELLS
  Gene Name: helicase, lymphoid-specific
  ENST ID: ENST00000394036
  CDS Start-End: 1-2655
atgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccaggaaagaattcctagaatgtatgtgtcagagtttacagatgagggcttctttgaaggcaaattgccctccagaaaagatttatatgatatacgtccatatgaaaatacttatttactcaagcttcataccaattttgagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 140034 - DNA, 2699 bp, Homo sapiens
  Payload ID: 7463
  Gene Symbol: HELLS
  Gene Name: helicase, lymphoid-specific
  Uniprot ID: Q9NRZ9
  ENST ID: ENST00000394045
  CDS Start-End: 1-2223
atgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 140035 - DNA, 711 bp, Homo sapiens
  Payload ID: 7463
  Gene Symbol: HELLS
  Gene Name: helicase, lymphoid-specific
  ENST ID: ENST00000419900
  CDS Start-End: 136-711
aggagaagcgcgcttttttccctggcgggggatttggctagaaggctgggccggcagcggttgtgaggagttagctcgcggcattgcaggctctgagaggaggggacccggttcccgggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcag

SEQ ID NO: 140036 - DNA, 400 bp, Homo sapiens
  Payload ID: 7463
  Gene Symbol: HELLS
  Gene Name: helicase, lymphoid-specific
  ENST ID: ENST00000630929
  CDS Start-End: 107-400
gggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagagactgttatgaagatttaa

SEQ ID NO: 140037 - DNA, 3579 bp, Homo sapiens
  Payload ID: 7464
  Gene Symbol: HELQ
  Gene Name: helicase, POLQ-like
  Uniprot ID: Q8TDG4
  ENST ID: ENST00000295488
  CDS Start-End: 164-3469
gaagtttatgcgtgcttccggtccgcgagccctgagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgtgcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacagttgagtcatcatcaaatgaccttggtcctttttattcattacccagcaaagtgagagacctttatgcccaattcaagggaattgaaaaattatatgaatggcaacatacttgtttaacattgaattctgtgcaagaaagaaaaaatttaatatattccttgccaacaagtggtggaaaaaccctcgtggctgagattttaatgctgcaagaactgctttgctgtcggaaagatgttttaatgattcttccatatgtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcaaaacgactcaaattattggtatgagtgcaacattaaacaatgttgaagacctacaaaagtttcttcaagcagaatattataccagtcaatttagaccagttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatgaaaaaatacatttcagttatacattaagaa

SEQ ID NO: 140038 - DNA, 3429 bp, Homo sapiens
  Payload ID: 7464
  Gene Symbol: HELQ
  Gene Name: helicase, POLQ-like
  ENST ID: ENST00000508591
  CDS Start-End: 112-1581
tttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgtgcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacagttgagtcatcatcaaatgaccttggtcctttttattcattacccagcaaagtgagagacctttatgcccaattcaagggaattgaaaaattatatgaatggcaacatacttgtttaacattgaattctgtgcaagaaagaaaaaatttaatatattccttgccaacaagtggtggaaaaaccctcgtggctgagattttaatgctgcaagaactgctttgctgtcggaaagatgttttaatgattcttccatatgtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcagttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatgaaaaaatacatttcagttatacattaagaa

SEQ ID NO: 140039 - DNA, 3315 bp, Homo sapiens
  Payload ID: 7464
  Gene Symbol: HELQ
  Gene Name: helicase, POLQ-like
  ENST ID: ENST00000510985
  CDS Start-End: 131-3235
gagagctaacttggggtcttttcccaaggtggatgtagaagcgggctccggcgtcccactctcccttccatatgggcttagcgtctgggtcactgagaacgacgtctgaatagggccctgggtccttgccatggatgaatgtggttcccgcatccgccggcgggtgtctctccccaaaaggaaccgtccaagcttggggtgtatttttggcgctcccaccgcggccgagctcgtgcccggagatgaggggaaagaggaggaggaaatggtggctgagaacaggaggcggaaaaccgcgggcgtactgccggttgaggtacagccccttctactctcagattccccggaatgtctcgtccttggaggtggtgatacaaacccggacctcctacgtcacatgcccactgacagaggggtgggagaccagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacagttgagtcatcatcaaatgaccttggtcctttttattcattacccagcaaagtgagagacctttatgcccaattcaagggaattgaaaaattatatgaatggcaacatacttgtttaacattgaattctgtgcaagaaagaaaaaatttaatatattccttgccaacaagtggtggaaaaaccctcgtggctgagattttaatgctgcaagaactgctttgctgtcggaaagatgttttaatgattcttccatatgtggcaattgtccaagaaaagttgcacatgattggtgaaggaagccgtggagctacactggaaatgaccctagcaaaaatcctctacactagcaaaacgactcaaattattggtatgagtgcaacattaaacaatgttgaagacctacaaaagtttcttcaagcagaatattataccagtcaatttagaccagttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatg

SEQ ID NO: 140040 - DNA, 5317 bp, Homo sapiens
  Payload ID: 7465
  Gene Symbol: HLTF
  Gene Name: helicase-like transcription factor
  Uniprot ID: Q14527
  ENST ID: ENST00000310053
  CDS Start-End: 195-3224
ttgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 140041 - DNA, 3896 bp, Homo sapiens
  Payload ID: 7465
  Gene Symbol: HLTF
  Gene Name: helicase-like transcription factor
  Uniprot ID: Q14527
  ENST ID: ENST00000392912
  CDS Start-End: 169-3198
gtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggatta

SEQ ID NO: 140042 - DNA, 1276 bp, Homo sapiens
  Payload ID: 7465
  Gene Symbol: HLTF
  Gene Name: helicase-like transcription factor
  ENST ID: ENST00000467858
  CDS Start-End: 1-1276
gactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcagccttttctctaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatca

SEQ ID NO: 140043 - DNA, 3633 bp, Homo sapiens
  Payload ID: 7465
  Gene Symbol: HLTF
  Gene Name: helicase-like transcription factor
  Uniprot ID: Q14527
  ENST ID: ENST00000494055
  CDS Start-End: 219-3248
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaaga

SEQ ID NO: 140044 - DNA, 5306 bp, Homo sapiens
  Payload ID: 7465
  Gene Symbol: HLTF
  Gene Name: helicase-like transcription factor
  ENST ID: ENST00000465259
  CDS Start-End: 187-3213
gaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 140045 - DNA, 1008 bp, Homo sapiens
  Payload ID: 7466
  Gene Symbol: HELT
  Gene Name: helt bHLH transcription factor
  ENST ID: ENST00000338875
  CDS Start-End: 1-984
atgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtgagaacccccgtttctcataaagtgatagaaaagcggaggagggacaggatcaaccgctgcttgaacgagctgggcaagacagtgcccatggccttggcgaagcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttct

SEQ ID NO: 140046 - DNA, 846 bp, Homo sapiens
  Payload ID: 7466
  Gene Symbol: HELT
  Gene Name: helt bHLH transcription factor
  Uniprot ID: A6NFD8
  ENST ID: ENST00000505610
  CDS Start-End: 89-814
acctgggacactcgaggaggcacacgaggcggaaaagtggacgggtgccccgcgccaccgcctctcccgagggcgcgtactgaccaggatgtcagacaagctcaaggaacgcaaaagaacccccgtttctcataaagtgatagaaaagcggaggagggacaggatcaaccgctgcttgaacgagctgggcaagacagtgcccatggccttggcgaagcagagttccgggaagctggagaaggcggagatcctcgagatgaccgttcagtacctgagagcactgcactccgctgattttccccggggaagggaaaaagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctt

SEQ ID NO: 140047 - DNA, 841 bp, Homo sapiens
  Payload ID: 7466
  Gene Symbol: HELT
  Gene Name: helt bHLH transcription factor
  Uniprot ID: A6NFD8
  ENST ID: ENST00000515777
  CDS Start-End: 89-817
acctgggacactcgaggaggcacacgaggcggaaaagtggacgggtgccccgcgccaccgcctctcccgagggcgcgtactgaccaggatgtcagacaagctcaaggaacgcaaaagaacccccgtttctcataaagtgatagaaaagcggaggagggacaggatcaaccgctgcttgaacgagctgggcaagacagtgcccatggccttggcgaagcagagttccgggaagctggagaaggcggagatcctcgagatgaccgttcagtacctgagagcactgcactccgctgattttccccggggaagggaaaaagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttct

SEQ ID NO: 140048 - DNA, 1633 bp, Homo sapiens
  Payload ID: 7467
  Gene Symbol: HN1
  Gene Name: hematological and neurological expressed 1
  ENST ID: ENST00000304834
  CDS Start-End: 279-413
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagacacggggtcttgccatgttgcccaggctggtcttgaactcctaggctcaagtgatgatcctgccttggcctcctagggtgctgggattacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaat

SEQ ID NO: 140049 - DNA, 1519 bp, Homo sapiens
  Payload ID: 7467
  Gene Symbol: HN1
  Gene Name: hematological and neurological expressed 1
  Uniprot ID: Q9UK76
  ENST ID: ENST00000356033
  CDS Start-End: 279-824
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaat

SEQ ID NO: 140050 - DNA, 1605 bp, Homo sapiens
  Payload ID: 7467
  Gene Symbol: HN1
  Gene Name: hematological and neurological expressed 1
  Uniprot ID: Q9UK76
  ENST ID: ENST00000409753
  CDS Start-End: 287-751
gcgggcttaggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggcagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 140051 - DNA, 576 bp, Homo sapiens
  Payload ID: 7467
  Gene Symbol: HN1
  Gene Name: hematological and neurological expressed 1
  Uniprot ID: Q9UK76
  ENST ID: ENST00000481647
  CDS Start-End: 140-466
ccggcgggctccttaccctcgccgtgcccccactccttattcggacctacctgacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcac

SEQ ID NO: 140052 - DNA, 411 bp, Homo sapiens
  Payload ID: 7467
  Gene Symbol: HN1
  Gene Name: hematological and neurological expressed 1
  ENST ID: ENST00000580380
  CDS Start-End: 131-411
ctcaattagaaaactgcaatttggttccaccacatcctgactactaccagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatc

SEQ ID NO: 140053 - DNA, 663 bp, Homo sapiens
  Payload ID: 7467
  Gene Symbol: HN1
  Gene Name: hematological and neurological expressed 1
  Uniprot ID: Q9UK76
  ENST ID: ENST00000470924
  CDS Start-End: 121-447
cgcgcgcagccattggatccggagaccggatcgatcagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagat

SEQ ID NO: 140054 - DNA, 517 bp, Homo sapiens
  Payload ID: 7467
  Gene Symbol: HN1
  Gene Name: hematological and neurological expressed 1
  ENST ID: ENST00000581874
  CDS Start-End: 116-430
agcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaaggtcagtgtgacagcatgaggccagaaaggctttcagggagaaggtgatattcatgaaaatgtggacacagacttgccaggcagcctggggcagagtgaagagaag

SEQ ID NO: 140055 - DNA, 1614 bp, Homo sapiens
  Payload ID: 7467
  Gene Symbol: HN1
  Gene Name: hematological and neurological expressed 1
  Uniprot ID: Q9UK76
  ENST ID: ENST00000482348
  CDS Start-End: 472-798
acttacttggtggaagggtttggattctgtggaaggtgtccacattgtctcagctaattgcacactgttctttaaggtgggttacagttatgtctgggatcctcttcaaggcttggaagaagcttaaatcacttttttgagcatgtattttacatcgattatgacctgcattcatgtgtggctaccctcggggtcctggccaagtggcacaaagggagccattttgtggggctaagaagacacgtgaaatagccatatctcacaggggttagagaacttgggaacaaaaagcacgcctcactcagcaattgagccttaggaggaaagcatgggaaatgacattcctttacaactcaatactttcaggtttacaaggtcaaaaagactagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctg

SEQ ID NO: 140056 - DNA, 2289 bp, Homo sapiens
  Payload ID: 7467
  Gene Symbol: HN1
  Gene Name: hematological and neurological expressed 1
  Uniprot ID: Q9UK76
  ENST ID: ENST00000476258
  CDS Start-End: 1109-1435
cgtgcgctgtgctcgcgccggggcgggtggcggggttctgccgtcggcgccgcctttgtgccgcctggcgagccctgcgcgccggccccacccgggtccctgctgctctccattcattccttccacggagtcaggggctgaggaggccggggctggtcgcccctcggagcacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcaggtccggcgggctccttaccctcgccgtgcccccactccttattcggacctacctgacaggtgcatgtgtggtcgagcggggctggtcatcgcgacccttcaccccccattgaggacccaatcgttcttcccctcttcgaagtgcctcccctcttccaagtgtctccccttcctaacaaaggaaagaccccttctccccatccctgcgctcatttctaaggcggggggcgggggcgggcgcggggaacgagccaacccgagtgggttttctgcgcttaaaccttcggaccgtggcctttgcatcctaccttcgcttcctcctttgacgtttgcccagtgagttcatccctggccctggttcccttgcaggaggaggtttcttgttcttgggcggggccggagacatccattgtctctaacgtggtagcgctacctgggaagcgggggatttttcttgcccttcttcccactgctttttgggcttggggcactgggtacagtgtttggacaggaacccttttccaagtccttgcttaacttacttggtggaagggtttggattctgtggaaggtgtccacattgtctcagctaattgcacactgttctttaagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 140057 - DNA, 3718 bp, Homo sapiens
  Payload ID: 7468
  Gene Symbol: HN1L
  Gene Name: hematological and neurological expressed 1-like
  Uniprot ID: Q9H910
  ENST ID: ENST00000248098
  CDS Start-End: 58-630
acctgcgctgggcgggcgggaacggcgcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagagcttttgcctgtcagttgtgtgtgtcccttatagtcccttcccccacagctcttgctgaaagagtttgccttgttttgttttgttgttttgtatttagccagaggatgccaaaattagtcttctcaaagctttgagtagagtaagtgtgggaataagccagtttttttttttctgtttctgtaacttaaatgaacgggtttttttcccttgtatgccacttgtcctaacatgtccttaaggtgtttaacctgcctctgacctggcttgcaatgcataggtgaggagaagcagagagcttgtcatatgcaagtcctgtcaagaaaacaggtgggcatggtggctcaggtctgtagtctttgggtctttgggaggccagggtgggaggatcacttgagctcaggagtttgagaccagcctagacaacatactacgaccctgtctatacaaaaaaaaacttctctaaattagccggatgtggtggtgcatgcctgtagtcccagctactcgggaggctgagtgaggcaggaggatcacttgagaccaggaggttgtggctgtagtgagtgatgatcatgccactgcacttcagcctggaccacagagcaagaccctgtgtaaaaaaataaaataaaaaacagattggatgtctttcttctga

SEQ ID NO: 140058 - DNA, 962 bp, Homo sapiens
  Payload ID: 7468
  Gene Symbol: HN1L
  Gene Name: hematological and neurological expressed 1-like
  ENST ID: ENST00000382710
  CDS Start-End: 155-691
atattgactttcacgctccagaagttagctgcacagggccgcactaaagtcatactcacactaccctgggggactggtttctggacaaggtgttgagaaagggagaaaactcttccttttaggatggtgaggaaggaaagccggtctgaactggatgatgagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagg

SEQ ID NO: 140059 - DNA, 894 bp, Homo sapiens
  Payload ID: 7468
  Gene Symbol: HN1L
  Gene Name: hematological and neurological expressed 1-like
  Uniprot ID: Q9H910
  ENST ID: ENST00000382711
  CDS Start-End: 131-655
gcgcgcggcgagctgagggtggcggcggtcgacatgttccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtc

SEQ ID NO: 140060 - DNA, 1065 bp, Homo sapiens
  Payload ID: 7468
  Gene Symbol: HN1L
  Gene Name: hematological and neurological expressed 1-like
  ENST ID: ENST00000561516
  CDS Start-End: 35-247
ggcgcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattg

SEQ ID NO: 140061 - DNA, 601 bp, Homo sapiens
  Payload ID: 7468
  Gene Symbol: HN1L
  Gene Name: hematological and neurological expressed 1-like
  ENST ID: ENST00000566691
  CDS Start-End: 256-601
atattgactttcacgctccagaagttagctgcacagggccgcactaaagtcatactcacactaccctgggggactggtttctggacaaggtgttgagaaagggagaaaactcttccttttaggatggtgaggaaggaaagccggtctgaactggatgatgaggtatcactggaagcttctgcttggggtccaccagacgctgcacatttgccactcatctgaacggggtcgagtcgcagggcgggcgccttggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaagga

SEQ ID NO: 140062 - DNA, 593 bp, Homo sapiens
  Payload ID: 7468
  Gene Symbol: HN1L
  Gene Name: hematological and neurological expressed 1-like
  ENST ID: ENST00000566742
  CDS Start-End: 24-593
agctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagc

SEQ ID NO: 140063 - DNA, 570 bp, Homo sapiens
  Payload ID: 7468
  Gene Symbol: HN1L
  Gene Name: hematological and neurological expressed 1-like
  ENST ID: ENST00000566925
  CDS Start-End: 1-234
atgttccaggtcccggatagcgagggcggccgcgccggctccaggaaatggcaactgctgacaggaagtttggcatccacctcccccagcctcctgagtggacaggggccctgggcaccacttcagaggtcggccagcacacgcttggtttctgggggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaagga

SEQ ID NO: 140064 - DNA, 458 bp, Homo sapiens
  Payload ID: 7468
  Gene Symbol: HN1L
  Gene Name: hematological and neurological expressed 1-like
  ENST ID: ENST00000562569
  CDS Start-End: 1-351
ccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggcattatgtggattcagggtaaacttctcagactgtgagcctgagagttcctctctaggaggctccacaccattctgcctgctagatcggggccagatgagatgaaagtcaacgcttgagaaagaaaaccaacatgcattaactg

SEQ ID NO: 140065 - DNA, 565 bp, Homo sapiens
  Payload ID: 7468
  Gene Symbol: HN1L
  Gene Name: hematological and neurological expressed 1-like
  ENST ID: ENST00000565851
  CDS Start-End: 63-565
cacagtgacaagctttcaggtctgccatcagtaattggcatgtactctgtgcttgtagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaa

SEQ ID NO: 140066 - DNA, 782 bp, Homo sapiens
  Payload ID: 7468
  Gene Symbol: HN1L
  Gene Name: hematological and neurological expressed 1-like
  ENST ID: ENST00000569765
  CDS Start-End: 1-297
atgttccaggtcccggatagcgagggcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtg

SEQ ID NO: 140067 - DNA, 3185 bp, Homo sapiens
  Payload ID: 7468
  Gene Symbol: HN1L
  Gene Name: hematological and neurological expressed 1-like
  Uniprot ID: Q9H910
  ENST ID: ENST00000562684
  CDS Start-End: 37-693
acggcgcgcggcgagctgagggtggcggcggtcgacatgttccaggtcccggatagcgagggcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagagcttttgcctgtcagttgtgtgtgtcccttatagtcccttcccccacagctcttgctgaaaga

SEQ ID NO: 140068 - DNA, 613 bp, Homo sapiens
  Payload ID: 7469
  Gene Symbol: HCST
  Gene Name: hematopoietic cell signal transducer
  Uniprot ID: Q9UBK5
  ENST ID: ENST00000246551
  CDS Start-End: 115-396
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacctgtagtcgtattctttctcaaagaaccccagagttcccaaagcctccctcccatgaactgtttctggatccaaggccccctcagaacccccacatgtccccatccc

SEQ ID NO: 140069 - DNA, 445 bp, Homo sapiens
  Payload ID: 7469
  Gene Symbol: HCST
  Gene Name: hematopoietic cell signal transducer
  Uniprot ID: Q9UBK5
  ENST ID: ENST00000437550
  CDS Start-End: 57-335
ctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacac

SEQ ID NO: 140070 - DNA, 2000 bp, Homo sapiens
  Payload ID: 7470
  Gene Symbol: HCLS1
  Gene Name: hematopoietic cell-specific Lyn substrate 1
  Uniprot ID: P14317
  ENST ID: ENST00000314583
  CDS Start-End: 93-1553
agtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctgtatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgaaccttctttctgttcagtcctaaaattcgaaataaagtgagactatggttcacctgta

SEQ ID NO: 140071 - DNA, 1560 bp, Homo sapiens
  Payload ID: 7470
  Gene Symbol: HCLS1
  Gene Name: hematopoietic cell-specific Lyn substrate 1
  ENST ID: ENST00000428394
  CDS Start-End: 80-1429
gaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattatgccaagggctttggtggccagtatggaatccagaaggaccgagtggataagagcgctgtcggcttcaatgaaatggaggccccgaccacagcttataagaagacgacgcccatagaagccgcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctgtatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcatt

SEQ ID NO: 140072 - DNA, 1219 bp, Homo sapiens
  Payload ID: 7470
  Gene Symbol: HCLS1
  Gene Name: hematopoietic cell-specific Lyn substrate 1
  Uniprot ID: P14317
  ENST ID: ENST00000495491
  CDS Start-End: 109-738
actgaagcagcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagca

SEQ ID NO: 140073 - DNA, 533 bp, Homo sapiens
  Payload ID: 7470
  Gene Symbol: HCLS1
  Gene Name: hematopoietic cell-specific Lyn substrate 1
  ENST ID: ENST00000497391
  CDS Start-End: 101-331
agcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaagatagatgagccttggtcatgtggtttcttccagcatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaag

SEQ ID NO: 140074 - DNA, 552 bp, Homo sapiens
  Payload ID: 7470
  Gene Symbol: HCLS1
  Gene Name: hematopoietic cell-specific Lyn substrate 1
  ENST ID: ENST00000464274
  CDS Start-End: 65-292
agagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagag

SEQ ID NO: 140075 - DNA, 1636 bp, Homo sapiens
  Payload ID: 7471
  Gene Symbol: HPGDS
  Gene Name: hematopoietic prostaglandin D synthase
  Uniprot ID: O60760
  ENST ID: ENST00000295256
  CDS Start-End: 92-691
acttactcgtcatataaacccaaggcacagtcacatacccagggatacaagacactgcagactcccgagagacataacacagaattgcaccatgccaaactacaaactcacttattttaatatgagggggagagcagaaattattcgttacatatttgcttatttggacatacagtatgaagaccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaaatggaacaatgtcatgttgatgctattgtggacactctggatgatttcatgtcatgttttccttgggcagagaaaaagcaagatgtgaaagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcaccc

SEQ ID NO: 140076 - DNA, 585 bp, Homo sapiens
  Payload ID: 7472
  Gene Symbol: HSH2D
  Gene Name: hematopoietic SH2 domain containing
  ENST ID: ENST00000593031
  CDS Start-End: 67-585
agctacagcgagggcctcggccatccaagggtctcccaggtgaccttccctccaccccaggaagctatgacagaggccgggaagctgcccctaccgctacccccacggctggactgggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagag

SEQ ID NO: 140077 - DNA, 507 bp, Homo sapiens
  Payload ID: 7472
  Gene Symbol: HSH2D
  Gene Name: hematopoietic SH2 domain containing
  ENST ID: ENST00000591154
  CDS Start-End: 1-122
ggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcaggatcccgcaaacgtggattacgaggatctcttcctctactccaacgcagtggccgaggaagctgcctgcccggtgtctgcccctgaggagacggagtcttgctttgtcgaccaagctggagtggaatggcacagtctaggctcgctgcaacctccgcctcccaggttcaagcgattctcctgcctcagcctcctgagtagctgggactacaggcctccccaaagccagtcctgtgtcaccaatcaaaggaa

SEQ ID NO: 140078 - DNA, 1364 bp, Homo sapiens
  Payload ID: 7472
  Gene Symbol: HSH2D
  Gene Name: hematopoietic SH2 domain containing
  ENST ID: ENST00000586872
  CDS Start-End: 118-336
attgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggtatgtatatgacaggaggctggcacctcccacctggctgaggggcaggagtggaggtggtcaacagcttccagaggaggctccttctagaatgagaatgcgatcctacagcttggtgctttaaacctttccagtgcttttgcaacaccgagattaaaattcaaactacaatctgaggtcctctttctgcctgtcacctacccagcgccagccctgctgccataccgtctgttgttcagacacaccaagctagcctcggggtctctgcgtgtgccggccccacctcaggtcctttgcacaaactgtgtgccctgcccctagatttcccatgtcttcattcatttctccttcaagtgcctccttccccaggcc

SEQ ID NO: 140079 - DNA, 2473 bp, Homo sapiens
  Payload ID: 7472
  Gene Symbol: HSH2D
  Gene Name: hematopoietic SH2 domain containing
  ENST ID: ENST00000616070
  CDS Start-End: 112-321
gtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagacagccttggaagtggagtttactctccccttgaggaagctgaaggtcagaaagggagagacgattgcctgaggtcacacagctgatggacagtagagctgggttatgaactcgaatgcatctgagcatacagggatgctgagaacttgctggagtcacagccactgggatcctttctcatcagggtcagtcacagccatgtgggctacacactctcctacaagtaaggcctgggccgggatccagggcaggggcaggtgggctcttgggtttccttggagggggcaaggggtgcttcatgtcatagcttctcagaaagcagcagtaactgaggctgtggatctgagaacgggagctgctagccaagcaatgagtgaagcttttgtccgtagtggcatgttttatctgaggccagcctttgtactcctgtgttataaatgggggaaactgaggcacagcgaggttagtaacctgctgggtgttgcatggccagtgagtgaagaagcctgcatgggaacctggggtagtctggctgtagcagtgacgctgccggcccaagggctggggacttggggcagggatgagggggagtaggatgtcccagcccccgcagtgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaatt

SEQ ID NO: 140080 - DNA, 2366 bp, Homo sapiens
  Payload ID: 7472
  Gene Symbol: HSH2D
  Gene Name: hematopoietic SH2 domain containing
  Uniprot ID: Q96JZ2
  ENST ID: ENST00000616645
  CDS Start-End: 532-1590
gtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaacagtcaggtgtggtggtgtgtgcctgtagtcccagctacttgggagcctgaggcaggaggatcacttgagtccagcagttcaagactgcagtgagctatgatcataccactgcactccagcctgagtgacagagtgaaactctgtctctaaaatagggctcacctgcttgaggaaacaggaactgcctcggggcagccagccccgccccattgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaa

SEQ ID NO: 140081 - DNA, 1957 bp, Homo sapiens
  Payload ID: 7472
  Gene Symbol: HSH2D
  Gene Name: hematopoietic SH2 domain containing
  Uniprot ID: Q96JZ2
  ENST ID: ENST00000613986
  CDS Start-End: 118-1176
attgacgtgcagaccttgaatcgaaacccaggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaaagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcagaaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaaggccacagagctatgggtgtcagcaccaggatttgaagccaggtgaatccgagcccttttcccatatcatctgtttgttctgttgtctaaaagcacactgcaagccgggctcagtggctcatgcctgtagtcccagcactctgtggggccgaggcaggcagatcgcttgaggtcaggagttcgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaaaatgaaattaaaaaataaaa

SEQ ID NO: 140082 - DNA, 1508 bp, Homo sapiens
  Payload ID: 7472
  Gene Symbol: HSH2D
  Gene Name: hematopoietic SH2 domain containing
  ENST ID: ENST00000613195
  CDS Start-End: 88-345
ggctcctgcaggcactggcacagctacagcgagggcctcggccatccaagggtctcccaggtgaccttccctccaccccaggaagctatgacagaggccgggaagctgcccctaccgctacccccacggctggactggtttgtgcacacccagatgggccagctggcccaagacggggtccccgagtggttccatggtgcaatctcaagagaggatgctgagaacttgctggagtcacagccactgggatcctttctcatcagggtcagtcacagccatgtgggctacacactctcctacaatgtctccgcagagcccaaagcagctgctgccatttcatggtgaagctcttggatgatgggactttcatgatccccggggagaaggtggcccacacctcgctggacgccctggtcaccttccaccagcagaagccaattgagccgcgcagggagctgctgacacagccctgcaggcaggatcccgcaaacgtggattacgaggatctcttcctctactccaacgcagtggccgaggaagctgcctgcccggtgtctgcccctgaggaggcctccccaaagccagtcctgtgtcaccaatcaaaggaaaggaagccgtcagcagagatgaacagaataaccaccaaggaagccacttcctcctgccccccaaaatcccctcttggagagacccgccagaaactctggaggagcctcaaaatgctccccgagagaggccagagggtccggcagcagctaaaaagccacctcgccactgtgaacttgtcgtcactcttggatgtccggagatccacggtgatctcaggccctgggaccggaaaaggcagccaagatcactcaggggatcccacctcgggggacagaggctacacggatccctgtgtggccacatctctcaaaagcccctcacagccccaggcaccaaaagacagaaaggtccccaccaggaaggccgagaggtcggtcagctgcattgaggtgaccccaggggacaggagttggcaccaaatggtagtgagagccctatcctcccaggagtccaagccagagcaccagggcttggcagagcctgagaacgaccagctcccggaggagtaccaacaaccgccaccctttgcccctgggtactgctagagaacaggtccaccctggctctgggactcgctgccaggggctgccacactcctgaatgccttaacatttcttccatggccccacaccatggcatccgggggtcttcgggaacccgggaaatggaataaagatgtttttggggtctgttcctgcactcacccatggggtgagctggttattttagcaacaatcatcagagtgacgctgatggtttggggcaccagctatacatcagccccagtgccagaccttctattcattattttacgcctcagagcaaggccctcagggagggtcatcctccatgttttgaagaagagactgaggttcagagaggataagaggcgtgaccaa

SEQ ID NO: 140083 - DNA, 1727 bp, Homo sapiens
  Payload ID: 7473
  Gene Symbol: HHEX
  Gene Name: hematopoietically expressed homeobox
  Uniprot ID: Q03014
  ENST ID: ENST00000282728
  CDS Start-End: 37-849
cagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgt

SEQ ID NO: 140084 - DNA, 808 bp, Homo sapiens
  Payload ID: 7473
  Gene Symbol: HHEX
  Gene Name: hematopoietically expressed homeobox
  ENST ID: ENST00000492654
  CDS Start-End: 492-788
ccactggggaaagagggtcgtggtattgtaagcccagccggtagtgcccattctttttggggttaaaggtatgtctggatttagttctaggtgtgacggctgtgtgtctgtctgtgtgtgtacaaggctgtgtgcatctgcggtgtcagtgtgtgactttgggtatgtttgtgtgtcggtgggaacgtgttaggtccacgtgccggtgggtgtatgtgaatgtgtctggttgggtggcctcctggcctacctttgtcatccctggggcccgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatg

SEQ ID NO: 140085 - DNA, 1605 bp, Homo sapiens
  Payload ID: 7473
  Gene Symbol: HHEX
  Gene Name: hematopoietically expressed homeobox
  ENST ID: ENST00000472590
  CDS Start-End: 436-732
tgaaatcagaggaggccgcggctcccccggccaggattggaggctcctcgcgcaacctaatgcgggtgtccgggcccgagcgcttcccgcgcagccaggccttgtcggtgcagcagccccgctcctccccaacacgcacacacccggtgttcgcaagtgcggctcaccaagggagatccaagggggcaaaaagttatgtataaatccgagagccactggggaaagagggtcgtggtattgtaagcccagccggtagtgcccattctttttggggttaaaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgac

SEQ ID NO: 140086 - DNA, 1173 bp, Homo sapiens
  Payload ID: 7474
  Gene Symbol: HEBP1
  Gene Name: heme binding protein 1
  Uniprot ID: Q9NRV9
  ENST ID: ENST00000014930
  CDS Start-End: 160-729
ctcgccgcctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacagtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 140087 - DNA, 2056 bp, Homo sapiens
  Payload ID: 7474
  Gene Symbol: HEBP1
  Gene Name: heme binding protein 1
  ENST ID: ENST00000536942
  CDS Start-End: 152-553
ctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgtaaggagacaatccttcaggcatccatgggtggcgcttgattcccgtaccactccttgcatcacctctggcaagcattcgcgtcaaatttttatggttgctgaattaatttaagtaggaaatgctgaatcctaacagtttctcattttaatttcttcaggctgcagcacacacacatttgcattttatcagaataaatgccttggccagttgccaaattgatgggacgagcttaagctttgcttaagcttacagtgaatgtctacattagccatagcagggttctaggagactcagcaaatatcttaagtcaagccatggtctggattcgtggacacatgggaagcataaagggctgaggaatacctgatttctaccccacactccctttgaatgccagagagcagggagcatttgctagagctgggcttccatcctccttgttgttcctggatggtagtcctttgagcagagcacacatctattctcttgtcatcctggtcctgtttccaggacttcatgtggggtcattttcccttgactgtagagaatagcaggtgcaaatggttactagtttctatcccttgtgctccaaactgccctcagaaaccaagtcttctagatcattgatgactcctcacatttgttaaaacactcccatgtgacaggcaccaaaccaggctcagggaaagaccaggatcttcaccagaagtaatcataggtggtttggctccgctcaggagcaacctcatgaaaaattcacatacatataatattgcactggactgagtattggtccacttcagggacctccaaacttggctgccctgctgcaaccctgaacctgatggtgggaccattttccccggagctgtgtcaatgttctgagaatgtgagtttcaccgctgtgtgtagtcctaggccaggtgactgcagggccctccagaggacagtgaatgtaatgcagctgggagctagcaccggagcctcagctcctgtgcttgtcctgcagtcctcattcagacttcccagcttcccttcagagggtgtggagaaagcaaattaacttaacaatatcttttcctagggtggagatgcaccttgggtgcagcatttaaggaagcactcactctcacagctgtccaagtgcaggatggggactgagagtgagcgcctccttaaatcttgtgccctgggttagatgtctgcttgtcttttccattctatttcctgtgtttgggaagcagcaggtataataaaatgaacttgtattttatttgaattccagctctactgcttactagcagaatgatgcttgggaagttagccactttaagacttagcttttgcatttgttaagtgctgataatataacctcctatatatgatgtgtgtgtgtgtgcatgtaatgtaaccttataggattattgttaaatatctttcagtatttactaagatactatttatgtattacctaatgtttatgacctgaagcaggttttggcaa

SEQ ID NO: 140088 - DNA, 460 bp, Homo sapiens
  Payload ID: 7474
  Gene Symbol: HEBP1
  Gene Name: heme binding protein 1
  ENST ID: ENST00000535636
  CDS Start-End: 1-189
aagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatctgaaagtgccaaatgtggtgtctagcctggctccatggaatttttaacacggagttctcacacagcatatgatcattcctcaactcgccacttgatgtcactgcatagtcaaatgagcattcaaaattaccctgcagtggtttgtgttatttctgattctgttgaaagcaatgttaatgagatggtagaaggcaaatgtactacttcaaatgcaaaagtactctatcaaataatgcagtgagtgcattcaatgacaaaattaattctaaaatga

SEQ ID NO: 140089 - DNA, 844 bp, Homo sapiens
  Payload ID: 7475
  Gene Symbol: HEBP2
  Gene Name: heme binding protein 2
  ENST ID: ENST00000367697
  CDS Start-End: 250-600
gcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttc

SEQ ID NO: 140090 - DNA, 661 bp, Homo sapiens
  Payload ID: 7475
  Gene Symbol: HEBP2
  Gene Name: heme binding protein 2
  ENST ID: ENST00000448741
  CDS Start-End: 34-417
ccccggagagcctcggagctctggctgcccacgatgggagtcctctggggggcgccggagccgtgccgggtccccgccgcaggggacagtaacgcggagtcggcctggccggcggaaagggggtgctggggaacagagccgcaccccactcggctcgggaaagccctgcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttc

SEQ ID NO: 140091 - DNA, 512 bp, Homo sapiens
  Payload ID: 7475
  Gene Symbol: HEBP2
  Gene Name: heme binding protein 2
  ENST ID: ENST00000453452
  CDS Start-End: 1-137
agatgaaaataaagatgacagctccagtgacaagctacgtggagcctggttcaggtccttttagagagggaaaaaggggcaatgtgcaagtgaaaatcgagtctggaaaaggggcttctacaggggtgttggtgtagttctctgatcagcagcaccggcatggatgtgggagctcggaggaaatacactctcaggccccaccccagacctgaatctgcatcgtagcaaaatccccaggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaa

SEQ ID NO: 140092 - DNA, 10014 bp, Homo sapiens
  Payload ID: 7475
  Gene Symbol: HEBP2
  Gene Name: heme binding protein 2
  Uniprot ID: Q9Y5Z4
  ENST ID: ENST00000607197
  CDS Start-End: 278-895
ggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaattatttatcttgtgtggaacccctaggctgtcaggcccggagaggtgaaattcagctggacacaaaaatcaaattgtcttttgtggctgccaccattacattctctgttgtatgtattactttccctcctgcatcctcccactgccccactgcacaagaatactccatgtaactccatttaaatgtaatgaattcattcctttctttctggtctccacttaaccccctaaaaatcttgctttttcccctaaacatttccctgaactgtcacgtattttcattcattctttaactcattgtagggagtccctgctatgttccaagcactctgctaaggactgggaggtggtggtaagaaaacctgtgtcccaagcccctcatcactgacttcctcttcactaactccaacaacatctttccacctccttaactatttcattcaccctcccactgtgaacaccacagacaaggcccctggcctcatggagtttacattctagagggtgagggagttcaacacaaataagatgcttgaaattggcaagtgtgatgaagaacagaatagggcagtggggtagagtgtggttaggtagggtgtggtggacatcacataaggtggtcagcaaaggcctctcaagagacagttgagacttgaatgacgaggatgagtcagatgaaagccaggggcagaggtgaggggagcatcttgggcagaggtgacagtgttaaagggagaggccacgttcagtacccagaacaaaaagctgcacacactgcttgctgagcaagagagcactgctcttgtagggcacggtctctcggataaagaaaactgcggaccttatgcagggttttaggaaggattaacagactttcaaaagcatttaggagtcgagggagctttagttgtggggatgcagttaccagagtgaggccgctgctgattagcatgatttagaagcctagtttggaggtgaggttactgatgggaaattgtcattgattgtttctggtacttaattgctactgtggccaaaggatggtcagttttattcaggatttgaagtggtggcagacaacgtgaggtgtgccactcaaattcaccttcaagaaagtaccagccgcccagctgtgaggggtgtggttcgccgacagtctccccgttaccgtcttcagggtccacgccagatttcaagataaggacacactattctgtgggagagagggacctagtctacaactgagcaaggcagtggtagctgacagcatgcttttttctggcaattcccagccaataactgagcaaggtggtggtataagacctagccatttaggccaggtgcagtggctcacagctgtaattccagcactttgggaggctaaggtgggaggattgcttgagcccagaagttcaagacgagtcatggcaacctagtgagactgtctgtccaaaaaataaaaaattagccaagcgtggtggcacacgcctgtattcctagctcctgaggtgaaaggattgcttgagctcgggaggcggaggttgcagtgagtcctgatcatgccactgcactccagcctgggtgacagagcaagatcctgtctcagaaagaaaaaaaaaagtcctagtcatttctaccaactcgaaagccctctaataagcagtctctgctctggagctttttggtgggctgctagagactttgttagatcctaccgttcctctgctcaatcctgcttttcccttttcctttcagagatgtcacttcaccagttttgtactcctaactccatctcagcctaaaattggcacaattggtaccagtggcccacgaacgtaggtggtaagacagcatttgcaggctgagtgactcactgtctggctggctcggaggcccccatccctggtggataggtggcacagacagtccctggcacaagaaggctgtccagtgatgaagacttcagatgaaatggcatgctggtgcaggggaacgcaatgactggtgggtgatttgggtgtctcaaatatgggaagggtggataaaagagacaaggacagtgggcttccatggttattgctgagttggattgacgtcctgcaagtggataatgaaaagctgaggtcaattaacaaacaaaactaagtgtgagccgcagagtctctgtggtagcttgccaacaatcctcatctcatgctgtagccaagcagagcaagctgaaggccaagcacaggatttgatggtaaaagtagctaacagccaacaaatactcaaccaagccaggtctgttagatcaaggttggaatcaaacttgggatcccaaaacatgggatgggagcatttagtggatctccccaaccatctgcctccctagaaaactccctgaatattcacatccttcagaagaggcccacccttccccatgaagagctggaactaccctcccttcctgcctcttccctaacacaagggaagacagtgtccaaggtctttccccatgaagcaaaaggtgtccctcaggactggtccctccccttctcctggctaccaggcctataacgagacttaagtcacaacataactgattgcggctgaggggtctgatgagggagaaatgggatctatgccagaggagccacctaacctggcagcatgtactgcaggggccaggggcgtactcttgggactggatcctgagggtgcttggtcaaaggggctgggtttatacaactagataaaggagagggtatattgacttggggctctcaggatagaggatttcacaccatgagaaaaatgccaggagataatacagactcactgctctagggcagcttggtagaagcctagaaagagtgatcaaaatgttgaaatgcctgaatggctgggacaaacaatagagaaaggaatgagaaggctcagggaagggagcatgccagcatggatatatgaggcaaggtgacccatcagacaattatgttccacgggaaggcccaggggacccatccttcagcaaggctgctgggaatgcactgataagcgggcttgggcatcataaaggagctcagcggtggctctcctcggcaggctggggctggcaggaagggctgtgatggaacttcacttgctgagagcaatgtggatgatgatgagaccttgaagagcccaggtggcagtgccagccacagaagccagggtgccatcagtatcctgttaaccactaagctccaaatggcagccgaggggtcctgacctgtaaagtctcatggaaatagttggtagaacaaggcattcctagggacaaaagagctgactaatcaacaagggtaaggctttatatataatcaaaagtgagcaagaattgatgagcaggggactgagagagatcactccaattaaaaaacaaaaacatgattccttgccagtttctagttcagttttctgacctagagctcattaattgcagaggtgactgtatcctaggggaaagtttcctgcaacatttcagcaggtgtacacagtaatgatcccctcattctttttctaaaggatctatggccatttactcaggtggctctaccctggggaaagaggaatacctggatacgtcagggtccaagttaacgtctgatacccagaaacccaaagagtcattacagttcctcctcctcccattaaaatgggagcatacagaggttagaaagtaaacgtagttctaatcaaagtttggcttacagcagatctcctgggcctgcaggttatctgcctaatccctgaatgtataattgagactgacatccttggcaggcagaataacccctacatttgttccttgacctgtggggaaagagtataagcttctaaactccctctcctccaatcagggcagtaaaccataataaatattgccttgaacagtattttttaagcacctcgggtgaacatctgcttctggccatgatgatgaattgggaacccaatttacctgtccctcttaaacaactaaaagcccagacaaaatatatgaaacaatggttttcagacactgaaagttcatagtacaggactgtgatctctgcgagaagggggaataatgaggtgagtccagtgattgctcaggcgaatggcctggaggcagtttctaggcagcaaagcagggagagggaagccagagaccagtggtcctgctgtgttgaggagatggagatcagtgtcaccggaggccaaggtgagtaagtgagaggagaggaggcagcagcacacagacagagagtgctgtagatctgcagtgggtcccctggagtccttggttgagtgaaggtgttagaagaaactacttaagccaagaaatgagtaactggaaattagtagagcaaataatttacagatcatctatggggctgggaaaagtttgtgtttccactagccagagtagaaataactcataatgcatgggtcatcaggtggagtcctccaacaggtgttgccttagtactgaggtcaaattgtccctagaccaaaggcttctttggacttcccctaacaaagcttaaagacaagccttggaaggatcaaactaatttcaagaaacttaactgtgaatcagaataaaacccaataccatttataggaatataacaaaatccatcaacaaacaacataacactcataattaccaacattcagtaaaaaattactggaaacagagaaatataaattatggcccataattaggaaaaaagggtaatcattagaagtagaaccagaagtgacagatatgaagaaattagcagcttgaattatgtgatgtggcagatcttatgtattggaggtagggggaaagaagatgcagtgtggaatagatgacaaggcccaatgagagaatcacagtgcaggtccctggggccctgaaggaaggtggttctaaccacaggagaggatcatatgctttttgaaaaacagcctctgctgtgctactgggccctggtagacacggaactttgagacccagtgatgctgtatccagaactgctcatcttaactaggtcctgtgggaagcactaagtcataagctagtaggatcggcagcagcccattggaagatggaaatgatatgtacaggagcagttccaagccagaccagaggacataagcaaactgcaagagcaattactccaaccgccatgtctgcacagtggcacctacatcccccctccctgtggttgttggaggacctgtatgatccactgaaggaagaggaatgcttgggcttggtttattgattagttatcttctgtagttgcaagctgaaaatggaccttcactcaaaggtgacattgaaaaacgggaaaaaaattgcaatcttcctgcaaaaactgggcagaattttttgaggtacactggatcattcaccttgtgagggaggacaggtaaaatatttatggaagtggcagaaaatggcctgccagctgatcaggagtttgggaggaaaaaaacatggattaggaggtctggggtagaggcatgtggatgggcatatggagtgaacacagaagttgaaaaactgtatcacatgttaatgcccactagatagcacccaccagagaagaggcactaaacaaccaagtagatgaaatgacttagcctgttctattagcttttgccagtgcccacctcagtgctggtaaaatgcacacataaagtggcagtggtggcaaagatggaggctatggatggaacccaccaacatgggctcccacttaccaaggccaacttagacactgctcactgtgactatccaacctgcctgcaacaaataccaatgctgagaccctgatgaggctgtgaagaccaactggtcgcttgatagcaaattcactatggtaggctcattctttcctagaagcaccagcagtttattcacacaaggacagacttcctattctaggtatgtggttcctttcgggcctacagggtcctgaacacaatctaaggacttacaaaacatctgaactgtcagcgtagatttgctgaatacgtgatctatacatgttaacacccaatcagggagagttcgccagcggtcataggatccactgctcctatcacatactgcgccacctagaagctgctagactgatggaatgttggcatggcctgctttagtgccaggtgggagacaataccctgccaagatgtgccaccgtctcctgcacacagtatacttattgaatcagaaagcctgtatgatgctgtgtctacaacaggaatatatagatttcagaaccaaggagtggaggcaggagtgaccccacttaccatcgcacccaacgaaccactgagggacttagtacttcccatgcccacaactccaggttctacagcatcagaagtcctagttctcagagactgtataccttctctaggcaatattgcaagaatcccattgaactacagtctgctgctactatgtgggcactttggactctgtgttcagggaccagtaggcaagaagtcaccatctagtcaagggtaattgaccctgaactgcaggaggaggcaagcctgctgtcagaggatagtggcgagagcaatgtgtgtggaacttagcggacccactggaggcaccctctgtactccttgcccagttgtaactgaatggactagtgcagcaaccctggtctgagaagggtttggctcccaggagctcaggaccctcaggaatgagagcttggtttatactatcaaaaaagccaccaagaccagcaaagatgacagttgtgggtgaggggaatttagaatgaagcagggagtaatgaggaccagttgtggttccaaaaccatttgcaggaaggtgctatagttggtcctaccaaactcctctttcaacatttatcctcaggaagagaggtccattggcgccctgaaacagtcactctctgcgtgtttttgggaaaatggatccacataggcaaggggtggaccatggcaggcatagagcggtgccacttagatcccccttcaagacaagatatgccatccagctgcaaggagtgtgggtagctggcagccaccagctgctacttcaccaggatccaccttagctttcaagctgaggtcacgctattctcaagacaggaggggttggtggccaatgatttcactaaattatggaaattgagagcatgcttttctgagggggccctcttgccaaagaccaagcaaggccatggtacaaggacctaactgtttcagtccaacacaggactcctccaatgagtgacctttttcccagagttcccctgggatggcagctcgcctgctctccctgcctcgtcctgcttcctcttttcctttcaaaggtgcttactccaataataaatcctttggtattctaactgtctacttcttgaagaatctaaactggcagtaggatcatgcccctcactgatagctcaaccacgttttctatctttgggcctccttgtctttacctagcacatgagaagcatttattaggactttttttcccccattgctgaacaaatgactacagattgctctacctcttgttctgtgaataaaggctggccgctgtggaaggtaggtcagagcaggcaactgagagaaactgtattacagttaccgagtggcttattaaggaaagtggcgcaacaatcaggtccatgtttcattcaaatgaccctccattcccccaacaacatcctcacatctgccaaagcaaattatgctgctgtgctcatttgatgatggaatcagcatcgcatgcaggctgaacccctactacggcagaaccaagaaagccactctttcccctctcctcctaagatgccaccacagagcagggtgccagtggtgggtggggagaaagacggagacacagaaacgtctccttttcactgtgattctcctaaggaatatacagtcacccccacaggaaaagcaagagttcaatcaagattcttcagaaatagtaggatggcagaaagcagatcgcattgaggttgtttccaactgacagaccaagcagtaatttgtttctctccccactgatagtaaaaataaagtggaaataatttagggctggggcttctgtgattatctggaacttaaagtatgagggtatgagagccatcagatctacccctgtggagctttttaagatgcggtccataacagaagcgggccccaaggagtagagtagccacatggaaggtgccatgtttcagggatgagtctcgattcttctctccctgtatttcatccatgcctgtaagaagttctcacgtctctccacatgccacgtcatctgaaccgccaggcgataggttattcgtattttattccaaagtccataggacacgatgtggacttgtttttccacgtgcccttgtagatggtgccatccagtgtctgtgatgttccacctcctctgttgggttgtcacctcccccagagaccttctggtctcactgcttttctgtttgtatccagcaaaacactcaacaattctgtataagaacacctatctcattattcaaaaaaaatgcatgtataaacaaaaagaaatatttcaaatatttactttacaattgttttattcaaaggaaattaaatacaaatgtatatttttcattaaaaatggggatttaaaaatagttttataattagtgttatgttgctttatcttatctttgcataaattatgtattattaaaggtttctgatatccata

SEQ ID NO: 140093 - DNA, 1822 bp, Homo sapiens
  Payload ID: 7476
  Gene Symbol: HMOX1
  Gene Name: heme oxygenase 1
  Uniprot ID: P09601
  ENST ID: ENST00000216117
  CDS Start-End: 340-1206
gtgtgtgtgtgtgtgtgtgtgtgtgtgtgtatgtgtgtgtgtgtgtgtgtgtgtgtgtgttttctctaaaagtcctatggccagactttgtttcccaagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 140094 - DNA, 921 bp, Homo sapiens
  Payload ID: 7476
  Gene Symbol: HMOX1
  Gene Name: heme oxygenase 1
  ENST ID: ENST00000412893
  CDS Start-End: 361-921
cggggacttagtctcctccctgggtttggacactggcatcctgctttatgtgtgacaccactgcacccctctgagcctcggtttccccatctgtaaaatagaagcgatctaccctcacagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaac

SEQ ID NO: 140095 - DNA, 1621 bp, Homo sapiens
  Payload ID: 7477
  Gene Symbol: HMOX2
  Gene Name: heme oxygenase 2
  Uniprot ID: P30519
  ENST ID: ENST00000219700
  CDS Start-End: 81-1031
gccggcctcgcgccagtccgctgggctgcagggactgcggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140096 - DNA, 1644 bp, Homo sapiens
  Payload ID: 7477
  Gene Symbol: HMOX2
  Gene Name: heme oxygenase 2
  Uniprot ID: P30519
  ENST ID: ENST00000398595
  CDS Start-End: 549-1499
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaagatggagtctcgctctgttgcccaggctggagtgcagtggatcagtctagctcattgcagcctccacctcctgggttcaagagattctcctgcctcagcctcctgtgtagctgggattacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctag

SEQ ID NO: 140097 - DNA, 1727 bp, Homo sapiens
  Payload ID: 7477
  Gene Symbol: HMOX2
  Gene Name: heme oxygenase 2
  Uniprot ID: P30519
  ENST ID: ENST00000406590
  CDS Start-End: 187-1137
ccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140098 - DNA, 1752 bp, Homo sapiens
  Payload ID: 7477
  Gene Symbol: HMOX2
  Gene Name: heme oxygenase 2
  Uniprot ID: P30519
  ENST ID: ENST00000414777
  CDS Start-End: 212-1162
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140099 - DNA, 1797 bp, Homo sapiens
  Payload ID: 7477
  Gene Symbol: HMOX2
  Gene Name: heme oxygenase 2
  Uniprot ID: P30519
  ENST ID: ENST00000458134
  CDS Start-End: 308-1258
catctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctc

SEQ ID NO: 140100 - DNA, 877 bp, Homo sapiens
  Payload ID: 7477
  Gene Symbol: HMOX2
  Gene Name: heme oxygenase 2
  ENST ID: ENST00000570445
  CDS Start-End: 189-877
ggcggacaggcgacagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataa

SEQ ID NO: 140101 - DNA, 914 bp, Homo sapiens
  Payload ID: 7477
  Gene Symbol: HMOX2
  Gene Name: heme oxygenase 2
  ENST ID: ENST00000575051
  CDS Start-End: 200-914
gggtttgcccgccccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggacc

SEQ ID NO: 140102 - DNA, 583 bp, Homo sapiens
  Payload ID: 7477
  Gene Symbol: HMOX2
  Gene Name: heme oxygenase 2
  ENST ID: ENST00000576827
  CDS Start-End: 190-583
gggcacgctgactggaggctggcggacaggcgacagcgacctgcggcagagaacaacatgaagagaccttgctgctgctatgaaacccagactctaaggacaacttgggggacattggatattttttcacagatgtagacatcaaggagaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgccc

SEQ ID NO: 140103 - DNA, 514 bp, Homo sapiens
  Payload ID: 7477
  Gene Symbol: HMOX2
  Gene Name: heme oxygenase 2
  ENST ID: ENST00000570622
  CDS Start-End: 1-332
cccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggt

SEQ ID NO: 140104 - DNA, 2147 bp, Homo sapiens
  Payload ID: 7477
  Gene Symbol: HMOX2
  Gene Name: heme oxygenase 2
  Uniprot ID: P30519
  ENST ID: ENST00000570646
  CDS Start-End: 606-1556
caaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 140105 - DNA, 549 bp, Homo sapiens
  Payload ID: 7477
  Gene Symbol: HMOX2
  Gene Name: heme oxygenase 2
  ENST ID: ENST00000572812
  CDS Start-End: 220-549
actgcggcgcctgagggagtcgctgacgggcacgctgactggaggctggcggacaggcgacagcgacctgcggcagagtcttgctgcgacacccaggctggagtgcaatggcgctatctcggctcactgcaacctccgcttcccggattcaagcgattctcctgcctcagcctcccgagaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgacc

SEQ ID NO: 140106 - DNA, 1027 bp, Homo sapiens
  Payload ID: 7477
  Gene Symbol: HMOX2
  Gene Name: heme oxygenase 2
  Uniprot ID: P30519
  ENST ID: ENST00000575120
  CDS Start-End: 84-947
gcagggactgcggcgcctgagggagtcgctgacgggcacgctgactggaggctggcggacaggcgacagcgacctgcggcagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactacc

SEQ ID NO: 140107 - DNA, 607 bp, Homo sapiens
  Payload ID: 7477
  Gene Symbol: HMOX2
  Gene Name: heme oxygenase 2
  ENST ID: ENST00000575129
  CDS Start-End: 212-607
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccag

SEQ ID NO: 140108 - DNA, 687 bp, Homo sapiens
  Payload ID: 7477
  Gene Symbol: HMOX2
  Gene Name: heme oxygenase 2
  ENST ID: ENST00000574466
  CDS Start-End: 296-687
actgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgc

SEQ ID NO: 140109 - DNA, 1703 bp, Homo sapiens
  Payload ID: 7477
  Gene Symbol: HMOX2
  Gene Name: heme oxygenase 2
  ENST ID: ENST00000613539
  CDS Start-End: 1-1113
atggagtctcgctctgttgcccaggctggagtgcagtggatcagtctagctcattgcagcctccacctcctgggttcaagagattctcctgcctcagcctcctgtgtagctgggattacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140110 - DNA, 1829 bp, Homo sapiens
  Payload ID: 7477
  Gene Symbol: HMOX2
  Gene Name: heme oxygenase 2
  Uniprot ID: P30519
  ENST ID: ENST00000620445
  CDS Start-End: 289-1239
catctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcagagaacaacatgaagagaccttgctgctgctatgaaacccagactctaaggacaacttgggggacattggatattttttcacagatgtagacatcaaggagaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140111 - DNA, 1703 bp, Homo sapiens; identical to SEQ ID NO: 140109
  Payload ID: 7477
  Gene Symbol: HMOX2
  Gene Name: heme oxygenase 2
  ENST ID: ENST00000617111
  CDS Start-End: 1-1113

SEQ ID NO: 140112 - DNA, 1727 bp, Homo sapiens; identical to SEQ ID NO: 140097
  Payload ID: 7477
  Gene Symbol: HMOX2
  Gene Name: heme oxygenase 2
  Uniprot ID: P30519
  ENST ID: ENST00000612525
  CDS Start-End: 187-1137

SEQ ID NO: 140113 - DNA, 1908 bp, Homo sapiens
  Payload ID: 7477
  Gene Symbol: HMOX2
  Gene Name: heme oxygenase 2
  Uniprot ID: P30519
  ENST ID: ENST00000621065
  CDS Start-End: 368-1318
catctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 140114 - DNA, 1621 bp, Homo sapiens; identical to SEQ ID NO: 140095
  Payload ID: 7477
  Gene Symbol: HMOX2
  Gene Name: heme oxygenase 2
  Uniprot ID: P30519
  ENST ID: ENST00000622146
  CDS Start-End: 81-1031

SEQ ID NO: 140115 - DNA, 1752 bp, Homo sapiens; identical to SEQ ID NO: 140098
  Payload ID: 7477
  Gene Symbol: HMOX2
  Gene Name: heme oxygenase 2
  Uniprot ID: P30519
  ENST ID: ENST00000615778
  CDS Start-End: 212-1162

SEQ ID NO: 140116 - DNA, 1829 bp, Homo sapiens; identical to SEQ ID NO: 140110
  Payload ID: 7477
  Gene Symbol: HMOX2
  Gene Name: heme oxygenase 2
  Uniprot ID: P30519
  ENST ID: ENST00000619528
  CDS Start-End: 289-1239

SEQ ID NO: 140117 - DNA, 1908 bp, Homo sapiens; identical to SEQ ID NO: 140113
  Payload ID: 7477
  Gene Symbol: HMOX2
  Gene Name: heme oxygenase 2
  Uniprot ID: P30519
  ENST ID: ENST00000619913
  CDS Start-End: 368-1318

SEQ ID NO: 140118 - DNA, 687 bp, Homo sapiens; identical to SEQ ID NO: 140108
  Payload ID: 7477
  Gene Symbol: HMOX2
  Gene Name: heme oxygenase 2
  ENST ID: ENST00000633088
  CDS Start-End: 296-687

SEQ ID NO: 140119 - DNA, 1797 bp, Homo sapiens; identical to SEQ ID NO: 140099
  Payload ID: 7477
  Gene Symbol: HMOX2
  Gene Name: heme oxygenase 2
  Uniprot ID: P30519
  ENST ID: ENST00000631540
  CDS Start-End: 308-1258

SEQ ID NO: 140120 - DNA, 877 bp, Homo sapiens; identical to SEQ ID NO: 140100
  Payload ID: 7477
  Gene Symbol: HMOX2
  Gene Name: heme oxygenase 2
  ENST ID: ENST00000631495
  CDS Start-End: 189-877

SEQ ID NO: 140121 - DNA, 914 bp, Homo sapiens; identical to SEQ ID NO: 140101
  Payload ID: 7477
  Gene Symbol: HMOX2
  Gene Name: heme oxygenase 2
  ENST ID: ENST00000631986
  CDS Start-End: 200-914

SEQ ID NO: 140122 - DNA, 583 bp, Homo sapiens; identical to SEQ ID NO: 140102
  Payload ID: 7477
  Gene Symbol: HMOX2
  Gene Name: heme oxygenase 2
  ENST ID: ENST00000631697
  CDS Start-End: 190-583

SEQ ID NO: 140123 - DNA, 549 bp, Homo sapiens; identical to SEQ ID NO: 140105
  Payload ID: 7477
  Gene Symbol: HMOX2
  Gene Name: heme oxygenase 2
  ENST ID: ENST00000634141
  CDS Start-End: 220-549

SEQ ID NO: 140124 - DNA, 1644 bp, Homo sapiens; identical to SEQ ID NO: 140096
  Payload ID: 7477
  Gene Symbol: HMOX2
  Gene Name: heme oxygenase 2
  Uniprot ID: P30519
  ENST ID: ENST00000631677
  CDS Start-End: 549-1499

SEQ ID NO: 140125 - DNA, 607 bp, Homo sapiens; identical to SEQ ID NO: 140107
  Payload ID: 7477
  Gene Symbol: HMOX2
  Gene Name: heme oxygenase 2
  ENST ID: ENST00000632175
  CDS Start-End: 212-607

SEQ ID NO: 140126 - DNA, 1027 bp, Homo sapiens; identical to SEQ ID NO: 140106
  Payload ID: 7477
  Gene Symbol: HMOX2
  Gene Name: heme oxygenase 2
  Uniprot ID: P30519
  ENST ID: ENST00000633319
  CDS Start-End: 84-947

SEQ ID NO: 140127 - DNA, 2147 bp, Homo sapiens; identical to SEQ ID NO: 140104
  Payload ID: 7477
  Gene Symbol: HMOX2
  Gene Name: heme oxygenase 2
  Uniprot ID: P30519
  ENST ID: ENST00000632458
  CDS Start-End: 606-1556

SEQ ID NO: 140128 - DNA, 514 bp, Homo sapiens; identical to SEQ ID NO: 140103
  Payload ID: 7477
  Gene Symbol: HMOX2
  Gene Name: heme oxygenase 2
  ENST ID: ENST00000633529
  CDS Start-End: 1-332

SEQ ID NO: 140129 - DNA, 18208 bp, Homo sapiens
  Payload ID: 7478
  Gene Symbol: HMCN1
  Gene Name: hemicentin 1
  Uniprot ID: Q96RW7
  ENST ID: ENST00000271588
  CDS Start-End: 230-17137
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaagagggggaaaaaaaagaaaatgatttcctgggaagttgtccatacagtattcctgtttgctcttctttattcttccctagctcaagatgcgagcccccagtcagagatcagagctgaggaaattcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgaacttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatctggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaatgaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatattccacctagtattaaaggaggaaatgtcaccacagacatatcagtattgatcaacagccttattaaactggaatgtgaaacacggggacttccaatgcctgccattacttggtataaggacgggcagccaatcatgtccagctcacaagcactttatattgataaaggacaatatcttcatattcctcgagcacaggtctctgattcagcaacatatacgtgtcatgtagccaatgttgctggaactgctgaaaaatcattccatgtggatgtctatgttcctccaatgattgaaggcaacttggccacgcctttgaataagcaagtagttattgctcattctctgacactggagtgcaaagctgctggaaacccttctcccattctcacctggttgaaagatggtgtacctgtgaaagctaatgacaatatccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatcgtctactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtgcacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccataacctggttcaaagatgggtggcctgtcagccttagcaattctgtgaggattctttcaggaggcaggatgctacggctgatgcagaccacaatggaagatgctggccaatatacttgcgttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcaagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggacattaatgaatgtgaacaagtgcctaaaccttgtgcacatcagtgctccaacacccccggcagcttcaagtgtatctgtccaccaggacaacatttattaggggacgggaaatcttgcgctggattggagaggctgccaaattatggcactcaatacagtagctataaccttgcacggttctcccctgtgagaaacaactatcaacctcaacagcattacagacagtactcacatctctacagctcctactcagagtatagaaacagcagaacatctctctccaggactagaaggactattaggaaaacttgccctgaaggctctgaggcaagccatgacacatgtgtagatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacagatttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 140130 - DNA, 720 bp, Homo sapiens
  Payload ID: 7478
  Gene Symbol: HMCN1
  Gene Name: hemicentin 1
  ENST ID: ENST00000414277
  CDS Start-End: 1-720
gccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatccc

SEQ ID NO: 140131 - DNA, 926 bp, Homo sapiens
  Payload ID: 7479
  Gene Symbol: HMCN2
  Gene Name: hemicentin 2
  ENST ID: ENST00000428715
  CDS Start-End: 1-926
gcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcc

SEQ ID NO: 140132 - DNA, 1920 bp, Homo sapiens
  Payload ID: 7479
  Gene Symbol: HMCN2
  Gene Name: hemicentin 2
  ENST ID: ENST00000611173
  CDS Start-End: 60-1847
tgtgtgaggcatctggggttcccccgccccgagtcatctggtatcgagggggtcttgaaatgatcctggcccctgagggctccagctctgggaagctgcggatcccggcggctcaggagagggatgctggcacctacacctgccgggctgtcaatgagttgggtgacgcctctgcagaaatccagctggcggttggacatgcgccccagctgacggagctgccccgggatgtcactgtggaactggggaggagtgccctcttggcatgccgggcaacaggccgcccgcccccgacggtcacctggcgccgcggagatggccagcctctgggactcaggctgggggccgggcgaggcagtaggtctcggcagccggattcgggagtgctgttctttgaaagtgtggccccagaagaccaggccccatatgtctgtgaagctcgaaacgtctttgggaaggtccaggctgaggcccggctcatcgtcactggtcacgccccgccacagatcgccagcagcgcccccaccgtccgggtcctggaggggcagcccgtgtccctgccctgcatcgtcctagctgggcggcccctcccggaaaggcactggctcaaggacggccggcccctcccacctggcagccggcattccatccgagcagacggcagcctccaccttgaccgagcattgcaggagcacgcggggaggtacagctgtgtggccaccaacacggccggctctcagcaccgggacgtggagctggtggtccaggtgccacctagaatccatcccactgccacccaccatatcaccaatgaaggggttgcggcctctcttccctgcgtcgcttcaggagttcccgcccccaccatcacgtggaccaaggaaaccaatgccctgacctccagaggtccccactacaatgtgagtaaggagggcaccctgctcatcgcccagccgtctgcccaggacgcaggggcctacgtctgcacggccaccaacaccgtgggcttttctagccaggagatgcgactttctgtcaacaccaaacccaggatccatatgaacgggtcacgtaatgcagatgtgcctctgcaagtcacagcgaaggctggcgaagaggtgaccctggactgcgaggccaagggctccccacccccactggtcacctggacgaaggactcccgccctgtaccgcccatcaccaacaggtatggcctcctcccgtctggctccctgcgtctggcccaggtgcaggtgggtgacagcggccactacgagtgcacagccagtaaccccgccgggtccgcctcccatcgctacgtccttggggtgcaaggtaggaccagctggcagccccagtccctccctgtcccccatcaccctgcctgtctctcaggtctctcagtgcccctcctgcagcccacgcccaggtctgtcaggctctgtcacctctccctccgtgcgcctctgccacctccttttgccacccccacttcctgtctctctcaggcctgtctctcctcctccaccctttctctccacctctccccataccccttgaggggtcctggagacgctgttcagaggcccccaacaacacagggcagagcacagtggggacttgggtttgggaggacaggggtcagaggggaacccatgaaggtgggtctgagagggtctctgcctggtacgcgaggcccagctgggagcccagggtgtggcgatgggaagaggcctgtgaggtgccacagagcccctcctgctgggagcatcttaatgcccccaagaggcccttctgagcccctgctcccaccactgccatcaacaaggcactttgtgcacctataacagtgggtgccgctctctctccatgtatcccttcctctagtccaaggcccctacgtaccccactgtgcctctg

SEQ ID NO: 140133 - DNA, 15610 bp, Homo sapiens
  Payload ID: 7479
  Gene Symbol: HMCN2
  Gene Name: hemicentin 2
  ENST ID: ENST00000624552
  CDS Start-End: 1-15180
atgcccggggcgccgctcctgcggctgctgaccgcggtctctgcggcagtggcagtggcagtggccggggcgcccgggacggtaatgccccccaccacgggggacgccaccctggccttcgtcttcgacgtcaccggctccatgtgggacgaactgatgcaggtgatcgatggcgcctcgcgcattctggaacgcagtctgagccgccgcagccaggccatcgccaactacgcgctggtgcccttccacgacccagatattggcccagtgaccctcacggcggaccccacagtgtttcagagggagctgagagaactctacgtgcagggaggtggtgactgcccggagatgagtgtgggggccattaaggctgccgtggaggttgccaaccccggatccttcatctacgtcttttcggatgcccgcgccaaagactatcacaagaaggaagagctgctgcggctcctgcagctcaagcaatcacaggtggtctttgtgctgacgggggactgtggcgaccgcacccatcctggctacctggcttatgaggagatcgctgccaccagctctgggcaggtgttccacctggacaagcagcaagtgacagaggtgctgaagtgggtggagtcagcgatccaggcctccaaggtgcacctgctgtccacagaccacgaggaggagggggagcacacatggagactcccctttgaccccagcctgaaggaggtcaccatctcattgagtgggccagggcctgagattgaagtccaagatccgctggggaggatcctgcaggaggacgagggcctcaacgtgcttctcaacatccctgactcggccaaggtcgtagcctttaagcctgagcatccggggctgtggtccatcaaggtctatagcagtggccgccattcagtgaggatcacaggcgtcagcaacattgacttccgagccggcttctccactcagcccttgctggacctcaaccacaccctcgagtggcccttgcaaggagtccccatctccctggtgatcaattccacgggcctgaaggcacccggccgcctagactcggtggagctggcacaaagctcagggaagcccctcctgactctgcccacgaagcccctctccaatggctccacccatcagctgtggggcgggccgcccttccacacccccaaggagcgcttctacctcaaggtgaagggcaaggaccatgagggaaaccccctccttcgtgtctctggagtgtcctacagtggggtggccccaggcgctcccctcgtcagcatggcccccaggatccatggctacctgcaccagcccctgctggtctcctgctcggtgcacagtgcccttcccttccggctgcagctgcggcgaggtgaagccaggctgggcgaagagaggcactttcaggagtcgggaaacagcagctgggagatcctgcgggcctccaaggccgaggagggcacgtacgagtgcacagccgtcagcagggctgggaccgggcgagcaaaggcccagattgttgtcacagaccccccgccgcagctggtccctgctcccaacgtgaccgtgtccccaggggagactgccgtcctatcctgccgggtcctaggcgaggccccctacaacctgacgtgggtccgggactggcgagtcctgccggcctcgacgggccgagttgcccagctggctgacctgtccctggagatcagtggcatcatccccacagacggcgggaggtaccagtgtgtggccagcaatgccaatggggtcacaagggcatccgtctggctcctggtgcgagaggccccacaggtcagcatccacaccagctcccagcacttctcccaaggtgtggaggtgaaggtcagctgctcagcctctggataccccacaccccacatctcctggagccgtgagagccaagccctacaagaggacagcagaatccatgtggacgcacagggaaccctgattattcagggggtagccccagaggatgctgggaattacagctgccaggcgactaatgaggttggcactgaccaggagacggtcaccctctactacacagacccaccgtcggtctctgctgtaaatgccgtggtgctggtggccgttggggaggaggctgtgttggtgtgtgaggcatctggggttcccccgccccgagtcatctggtatcgagggggtcttgaaatgatcctggcccctgagggctccagctctgggaagctgcggatcccggcggctcaggagagggatgctggcacctacacctgccgggctgtcaatgagttgggtgacgcctctgcagaaatccagctggcggttggacatgcgccccagctgacggagctgccccgggatgtcactgtggaactggggaggagtgccctcttggcatgccgggcaacaggccgcccgcccccgacggtcacctggcgccgcggagatggccagcctctgggactcaggctgggggccgggcgaggcagtaggtctcggcagccggattcgggagtgctgttctttgaaagtgtggccccagaagaccaggccccatatgtctgtgaagctcgaaacgtctttgggaaggtccaggctgaggcccggctcatcgtcactggtcacgccccgccacagatcgccagcagcgcccccaccgtccgggtcctggaggggcagcccgtgtccctgccctgcatcgtcctagctgggcggcccctcccggaaaggcactggctcaaggacggccggcccctcccacctggcagccggcattccatccgagcagacggcagcctccaccttgaccgagcattgcaggagcacgcggggaggtacagctgtgtggccaccaacacggccggctctcagcaccgggacgtggagctggtggtccaggtgccacctagaatccatcccactgccacccaccatatcaccaatgaaggggttgcggcctctcttccctgcgtcgcttcaggagttcccgcccccaccatcacgtggaccaaggaaaccaatgccctgacctccagaggtccccactacaatgtgagtaaggagggcaccctgctcatcgcccagccgtctgcccaggacgcaggggcctacgtctgcacggccaccaacaccgtgggcttttctagccaggagatgcgactttctgtcaacaccaaacccaggatccatatgaacgggtcacgtaatgcagatgtgcctctgcaagtcacagcgaaggctggcgaagaggtgaccctggactgcgaggccaagggctccccacccccactggtcacctggacgaaggactcccgccctgtaccgcccatcaccaacaggtatggcctcctcccgtctggctccctgcgtctggcccaggtgcaggtgggtgacagcggccactacgagtgcacagccagtaaccccgccgggtccgcctcccatcgctacgtccttggggtgcaagtcccccctcaggtgcagccaggccctcgggttctgaaggtgctggtgggagaagccctggatctgaactgtgtggctgagggcaacccagagccccagctgagctggtccaaggatggcgtggtgttgcagggccgggggcctcagggctccgtccacttcgcagccatcagaacctctgatgccgggaggtaccgctgtgaagcctccaacagcgccggggtggatgcctgggaggtggagctcagggtgctggagccaccacactggggggctgatgagaccagcggcctgctggagcgagtggccggagagaatgccagcctgccgtgccctgccagaggaacgcccaagccgcaggtcacatggaggaagggcccgtcctcggagcccctgcatggccagccaggtgtggcagtgctggaggaggggtctctgttcctggcctccgtctcacctgcggatagtggagactacgagtgccaggccaccaacgaggtgggctccacgtccaggagagccaagctggtggtctatgtgccccccagcatccgggaggacgggcgcaaggccaacgtgtcgggtatggccgggcagtccctgacgctggagtgtgacgcgaacggctttccagtccctgagatcgtgtggctgaaggacgcgcagctgattcctaaggtgggcggccaccgcctcctggacgagggccagtccctccacttccccaggatccaggagggtgattctgggctctactcctgccgggcagagaaccaggctggcaccgcccagagggacttccatctccttgtgctcacccctccttccgtgcttggagccggggccgctcaggaggtgctaggattggccggtgcagacgtggagctgcagtgttggacctcaggggtccccacgccccaggtggagtggaccaaggacaggcagcctgtccttccgggaggccctcacctgcaggtccaggaggatggccaggttctcaggatcaccggcagtcacgtgggggatgagggacgataccagtgcgtggccttcagcccagctggtcagcaggccagggacttccagctccgagttcatgcgccccccactatctggggctccaacgagacaggcgaggtggccgtcatggaggaccacctagtgcagctcctgtgtgaggctcgaggagtgcccaccccaaacatcacctggttcaaggacggggccctgctccccaccagcaccaaggtggtctacactaggggcggtcggcagttgcagctggggagggcccagagctccgatgccggcgtctacacctgcaaggccagcaatgctgtgggggccgcagagaaggccaccaggctggatgtttatgtcccacctaccatcgagggcgccggtggaagaccatacgtggtgaaggctgtggctgggaggcctgtggcgctggagtgcgtggccagaggccacccgtcccccaccctctcctggcaccacgaggggctgcccgtggcagagagcaacgagtcgcggctggagacagacgggagtgtgctgaggctggagagcccgggggaggcatccagtggcctgtacagctgtgtggccagcagtcctgccggggaagccgtcctgcagtactccgtggaggttcaggtgcccccacagctcctggtggctgaaggcttgggacaggtgaccaccatcgtgggacagcccctggaacttccctgccaggcctcaggctccccagtacccactatccagtggctgcagaatggccgcccagccgaggagctggctggggtgcaggtggcctcgcaggggaccacactgcacattgaccatgtggagctggaccactcaggcctcttcgcctgccaggccaccaatgaggcgggcactgccggggccgaggtggaggtgtctgtgcatgagttcccatcggtcagtatcattgggggtgagaacatcacagctcctttcctgcagcctgtgaccctccagtgcataggggatggggtgcccaccccaagcctccgttggtggaaggatggtgtagccctggcagcctttggggggaacctacagattgagaaggtggacctgagggacgagggcatctacacttgtgctgctaccaacctggctggggagagcaagagggaagtggcgctgaaagttttggtgccccccaacatcgagccaggcccagtcaacaaggcagtgctggaaaatgcctcagtgaccttggagtgtctggcttcgggcgtgccccctcctgatgtctcctggttcaagggccaccaacctgtctcttcatggatgggagtgacagtatcagtggatgggagagttctccgcattgagcaagcccagctttctgatgctgggagctaccgctgtgtggcatccaatgtggcaggtagcacagagctgcggtatggcctacgggtcaatgtgccccctcgaatcacactgccacccagcctgccaggccctgtgttggtcaacacccctgtccggctgacctgcaatgccaccggtgcccccagccccacactgatgtggctgaaggatggaaaccctgtgtcccctgcagggacccctggcctgcaggtcttccctgggggccgggtcctcaccttggctagtgcccgggcctccgactctgggaggtactcctgcgtggctgtgagcgcggtgggcgaggaccgccaggatgttgtcctgcaagtccacatgcccccgagtatccttggagaagagctgaatgtgtccgttgtggccaatgagtcagtggccctggagtgccagagccacgccatgccccctcctgtgctgagctggtggaaggacgggcggcccctggaaccacggcctggagtccacctctccgcagacaaagccttgctgcaggtggacagagccgatgtgtgggatgcgggccattacacctgtgaggcactgaaccaggccggccactcagagaaacactacaatctgaacgtctgggttgctccagtgttccccttgagggaatcccacaccctgactgtgagagaggggcaccctaccaggctgtcctgcgaatgccggggtgtccccttccccaagatctcctggaggaaggacggtcaacccctccccggggagggggctggcctccagcacgtgtcggctgtggggaggctgttgtacctgggacaggcccagctggctcaggaaggaacatacacctgtgaatgcagcaacgtggtggggaacagcagccaggacctgcagctggaggtgcacgttccccctcagattgccggtccccgggagcctcccacacaagtctctgtggtccaggatggagtggccactctggagtgcaacgccacagggaaaccccctccgacagtgacatgggagcgggacggccagcccgtgggggctgaactgggcctgcagctgcagaaccagggtcagagcctgcatgtggagcgggcccaggctgcccacactggacgctacagctgtgtggccgagaacctggctgggagggcagagaggaagtttgagctctccgtactggtgcccccagagctcattggagacttggacccgctgaccaacatcactgctgccttgcacagccccttaactctgctctgtgaagccatggggatcccacctccagccatccgctggttccgaggggaggagcctgtcagccccggggaggacacctacctgctggcaggtggctggatgctgaagatgactcagacacaggagcaagacagtggcctctactcatgcctggcaagcaacgaggctggggaggcacggaggaacttcagtgtggaggtgctggttcctcccagtattgagaacgaggacttggaggaggtgatcaaggtccttgatggacagactgcccatcttatgtgcaacgtcacaggccacccacagcccaagctcacatggttcaaagatggccggcctctggctaggggagatgctcaccacatctccccagacggagtcctcctgcaggtcctccaggcaaacctgtccagtgctggccactactcctgcattgcagccaacgctgttggggagaagaccaaacacttccagctcagtgtcctgttggctcccaccatcctgggaggggccgaggacagtgcagatgaggaggtgaccgtgactgtcaacaaccccatctctctgatctgcgaggccctggccttcccttcccccaacatcacctggatgaaggacggggccccgtttgaggcctccaggaacatccagctgctcccaggtacccacgggctgcagatcctgaatgcccagaaggaagatgctggccagtacacctgcgtggtcaccaatgagctcggggaggccgtgaaaaactaccatgtggaagtgctcatccccccttccatctccaaagacgaccccttggcggaggtcggcgtgaaggaggtgaagaccaaggtcaacagcaccttgaccttggagtgtgagagctgggctgtgcccccgcccaccatccgctggtacaaggatggacagcccgtgacccccagctcgcggctgcaggtcctgggtgaagggcgactgctccagatccagcccacacaggtctcagactcggggcggtacctgtgtgtggccaccaatgtggctggcgaggacgaccaggacttcaacgtgctcatccaggtgccccccatgttccagaaggtgggtgatttcagtgcagccttcgagatcctgtcccgggaggaggaggcccggggcggagtcacggaatacagggagatcgtggagaacaacccagcctacctgtactgcgacaccaacgcgatcccacccccggacctcacctggtacagagaggatcagcccctctcggccggggatgaggtgtctgtgctgcaaggaggccgggtcctgcagatccccctggtgcgggcagagaacgccgggaggtactcgtgcaaggcctccaacgaggtgggcgaggactggctgcactacgagctgctggtgctgaccccacctgtgatcctgggtgacacagaggagctggtggaagaggtgacagtcaatgccagcagcaccgtcagcctgcagtgcccggccctgggaaaccccgtgcccaccatctcatggctccagaatgggctgcctttctccccgagcccacggctgcaggtcctggaggacgggcaagtcttgcaggtttccacggcagaggtggccgacgccgccagctacatgtgtgtggccgagaaccaggcgggctccgctgagaagctcttcaccctcagggttcaagtcccgccacgaatcgcaggcctggacttggagcaggtcactgccatcctcaacagcagcgtctccctcccttgcgacgtccacgctcacccaaaccccgaggtcacgtggtacaaggacagccaggccctctccctgggtgaagaggtcttcctcctgcctggcacccacacgctgcagctggggagagcacggctgtcggactccgggatgtacacatgcgaagccctcaatgctgccggccgagaccagaagctggtgcagctcagtgttctggttcccccggccttcaggcaggctcccagaggtccccaggatgcggtcctggtgagggtcggggacaaagctgtcctgagctgcgagacagatgcgctccctgagccaactgtgacctggtacaaggatgggcagcccctggtcctggcacagcggacccaggctctgcggggtgggcagaggctggagatccaggaagcccaggtatcggataaaggtttatacagctgtaaagtcagcaacgtggctggggaggccgtgcggaccttcaccctcaccgtccaggtgcccccaacatttgagaaccccaagacagagacagtgagccaggtggctgggagccccctggtcctgacctgtgatgtgtccggggtccctgcacccacggtcacttggctgaaggacaggatgcctgtggagagcagcgcggtgcacggtgtggtctcccgggggggccgcctccagctgagccgcctgcaaccggcccaggcgggcacctacacgtgcgtggctgagaacacccaggctgaggcccgcaaggacttcgtggtagcagtgctggtggccccccggatccggagctcgggcgtggcgcgggagcaccatgtcttggaagggcaggaggtgcggctggactgtgaggccgatgggcagccgccgccggacgtggcctggctgaaggacggcagcccgctgggccaggacatgggcccccacctccggttctacctggacggcggctccctggtgctaaaaggcctgagggcctcggacgcgggtgcctacacctgcgtggcccacaacccagccggggaggacgccaggctgcacacggtgaatgtgctggttcctcccaccatcaagcagggagcagacggctcggggaccctggtgagcaggcctggggagctggtgaccatggtgtgccctgtgcggggctccccgcccatccacgtgagctggctcaaggacggcctgcccctcccgctctcccagcgcaccctcctccacggctctggccacaccctcaggatttccaaggtgcaattggcagacgctggcatcttcacctgtgtggccgcaagcccagctggcgtggcggacaggaacttcaccttgcaggtgcaggtgccccctgtcctggagccggtggagttccagaatgacgtggtggtggttcgtggctccctggtggaactcccgtgcgaggcccggggcgttcccctgcctctcgtgtcgtggatgaaggatggggaacccttgttgtcccagagcctcgagcaggggcccagcctgcagctggaggcagtgggagctggtgactcggggacctactcctgtgtggccgtgagcgaggcgggggaagccaggaggcatttccagctgaccgtcatggagccccctcacattgaggactcaggccagcctacagagctgtcgctgacccccggcgcccccatggagctcctctgtgatgcccagggcaccccccagcccaacatcacctggcataaggacgggcaggccctgaccaggctggagaacaacagcagagccacacgggtgctccgggtggagaatgtgcaggttagggatgctgggctgtacacttgtctggctgaaagccctgcaggtgcaattgagaagagcttccgggtcagggttcaagcccctccaaacattgttgggccccgaggcccccgctttgtggtcggcctggccccagggcagctggtcctggagtgttcggtggaggcagagccagcgcccaagatcacgtggcaccgagacggcattgtgctgcaggaggacgcccacacacaattcccggagcggggcaggttcctccagctgcaggccctgagcacggctgacagcggcgactacagctgcacagcccgcaacgccgcaggcagcactagtgtcgccttccgcgtggagatccacacggtgcccaccatccggtcaggaccacctgcagtgaacgtctcagtgaaccagacagccctgctgccttgccaggccgacggcgtgcccgcacccctcgtgagctggcggaaggacagggtccccctggatcccaggagccccaggtttgaaattctgcctgagggttccctgagaatccagccagtccttgcccaggacgccggccactacctctgcctggcatccaactctgctggctccgatcgtcaaggccgtgacctacgggtcttggccttgctgccctgcgaggccagcggctcccctaagcccctggtggtctggtggaaggacggacagaagctggacttccgcctgcagcagggcgcctaccggctcctgccctccaacgccctgctcctcacggcccccggcccccaggactcagcccagtttgaatgcgtggtgagcaatgaggtgggcgaggcccacaggctctaccaggtgaccgtccatgtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggcgccctggagatcgggcaggccctccccatccacgcaggccgctacacctgctcagcccgcaactctgccggcgtagcccacaagcacgtcttcctcactgtgcaagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggagtgagtacccaggtcctaccaggcggacagctgcggattgcccatgccagcccagaggatgctggaaactatctctgcatcgctaagaacagtgcgggcagtgccatggggaagacgcggctggtggtgcaagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacagaaggggtgtctgagcaggatggaggcagcacgctgcagcgggccgctgtctccagagaagacagcgggacctatgtctgctgggcggagaacagagtgggccgcacgcaggcggtcagcttcgtccacgtgaaggaggctcctgtcctacaaggggaggctttctcctacctggtggaacctgtaggaggcagcattcagctagactgtgtggtgcgtggagacccagtgccggacatccactggatcaaagatggccttccactgcggggcagccacctccggcaccagctgcagaatggctcgctgaccatccgcaggactgagagggacgatgcgggacggtaccagtgcctggcagagaatgagatgggcgtggcgaagaaagtggtgatcctcgtcctgcagagtgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggacagggacgagtgctcaggaggccctagcccctgctcccatgcctgccttaatgcacccggccgcttctcctgcacctgccccactggcttcgccctggcctgggatgacaggaactgcagagatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaaacgggagagggcattggcggccgccctggcgtgacccccgaggaaggggtcgaggagaagcttggtccacgccacctgctgtggcaagcggagcgtcatcgtctcccgccccgtgcgtcagcgagaccttgggtcaacacgaccctgcgcacagccttgacccccgacagcgaggacctgacctcacagagggaggcgtccagggcggcccttgggtggccagtcccgcaggcagggcccggggaagcccggatcagacctccaggtctgatccgcccctcagtgggagcgggacagggacacagggcacctggacgcgcgggagagggggcagaccccgcgttaggggtggcagcagctgtcgcccggccacacctggtggtgtcattctgaaccctgttgcaatataaagggatttttttttaaccaa

SEQ ID NO: 140134 - DNA, 4802 bp, Homo sapiens
  Payload ID: 7479
  Gene Symbol: HMCN2
  Gene Name: hemicentin 2
  ENST ID: ENST00000487727
  CDS Start-End: 1-1438
cgtccacgctcacccaaaccccgaggtcacgtggtacaaggacagccaggccctctccctgggtgaagaggtcttcctcctgcctggcacccacacgctgcagctggggagagcacggctgtcggactccgggatgtacacatgcgaagccctcaatgctgccggccgagaccagaagctggtgcagctcagtgttctggttcccccggccttcaggcaggctcccagaggtccccaggatgcggtcctggtgagggtcggggacaaagctgtcctgagctgcgagacagatgcgctccctgagccaactgtgacctggtacaaggatgggcagcccctggtcctggcacagcggacccaggctctgcggggtgggcagaggctggagatccaggaagcccaggtatcggataaaggtttatacagctgtaaagtcagcaacgtggctggggaggccgtgcggaccttcaccctcaccgtccaggtgcccccaacatttgagaaccccaagacagagacagtgagccaggtggctgggagccccctggtcctgacctgtgatgtgtccggggtccctgcacccacggtcacttggctgaaggacaggatgcctgtggagagcagcgcggtgcacggtgtggtctcccgggggggccgcctccagctgagccgcctgcaaccggcccaggcgggcacctacacgtgcgtggctgagaacacccaggctgaggcccgcaaggacttcgtggtagcagtgctggtggccccccggatccggagctcgggcgtggcgcgggagcaccatgtcttggaagggcaggaggtgcggctggactgtgaggccgatgggcagccgccgccggacgtggcctggctgaaggacggcagcccgctgggccaggacatgggcccccacctccggttctacctggacggcggctccctggtgctaaaaggcctgagggcctcggacgcgggtgcctacacctgcgtggcccacaacccagccggggaggacgccaggctgcacacggtgaatgtgctggttcctcccaccatcaagcagggagcagacggctcggggaccctggtgagcaggcctggggagctggtgaccatggtgtgccctgtgcggggctccccgcccatccacgtgagctggctcaaggacggcctgcccctcccgctctcccagcgcaccctcctccacggctctggccacaccctcaggatttccaaggtgcaattggcagacgctggcatcttcacctgtgtggccgcaagcccagctggcgtggcggacaggaacttcaccttgcagtgccccctgtcctggagccggtggagttccagaatgacgtggtggtggttcgtggctccctggtggaactcccgtgcgaggcccggggcgttcccctgcctctcgtgtcgtggatgaaggatggggaacccttgttgtcccagagcctcgagcaggggcccagcctgcagctggaggcagtgggagctggtgactcggggacctactcctgtgtggccgtgagcgaggcgggggaagccaggaggcatttccagctgaccgtcatggagccccctcacattgaggactcaggccagcctacagagctgtcgctgacccccggcgcccccatggagctcctctgtgatgcccagggcaccccccagcccaacatcacctggcataaggacgggcaggccctgaccaggctggagaacaacagcagagccacacgggtgctccgggtggagaatgtgcaggttagggatgctgggctgtacacttgtctggctgaaagccctgcaggtgcaattgagaagagcttccgggtcagggttcaagcccctccaaacattgttgggccccgaggcccccgctttgtggtcggcctggccccagggcagctggtcctggagtgttcggtggaggcagagccagcgcccaagatcacgtggcaccgagacggcattgtgctgcaggaggacgcccacacacaattcccggagcggggcaggttcctccagctgcaggccctgagcacggctgacagcggcgactacagctgcacagcccgcaacgccgcaggcagcactagtgtcgccttccgcgtggagatccacacggtgcccaccatccggtcaggaccacctgcagtgaacgtctcagtgaaccagacagccctgctgccttgccaggccgacggcgtgcccgcacccctcgtgagctggcggaaggacagggtccccctggatcccaggagccccaggtttgaaattctgcctgagggttccctgagaatccagccagtccttgcccaggacgccggccactacctctgcctggcatccaactctgctggctccgatcgtcaaggccgtgacctacgggtcttggccttgctgccctgcgaggccagcggctcccctaagcccctggtggtctggtggaaggacggacagaagctggacttccgcctgcagcagggcgcctaccggctcctgccctccaacgccctgctcctcacggcccccggcccccaggactcagcccagtttgaatgcgtggtgagcaatgaggtgggcgaggcccacaggctctaccaggtgaccgtccatgtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggcgccctggagatcgggcaggccctccccatccacgcaggccgctacacctgctcagcccgcaactctgccggcgtagcccacaagcacgtcttcctcactgtgcaagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggagtgagtacccaggtcctaccaggcggacagctgcggattgcccatgccagcccagaggatgctggaaactatctctgcatcgctaagaacagtgcgggcagtgccatggggaagacgcggctggtggtgcaagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacagaaggggtgtctgagcaggatggaggcagcacgctgcagcgggccgctgtctccagagaagacagcgggacctatgtctgctgggcggagaacagagtgggccgcacgcaggcggtcagcttcgtccacgtgaaggaggctcctgtcctacaaggggaggctttctcctacctggtggaacctgtaggaggcagcattcagctagactgtgtggtgcgtggagacccagtgccggacatccactggatcaaagatggccttccactgcggggcagccacctccggcaccagctgcagaatggctcgctgaccatccgcaggactgagagggacgatgcgggacggtaccagtgcctggcagagaatgagatgggcgtggcgaagaaagtggtgatcctcgtcctgcagagtgctccggtgttccaggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggtatggggcatccctgtctggaccttcgtggacagaggcaggatctcttgccgatggggattgtgtggtgcttatgggagacctgtcccctgccttgccagctccccacctcttccctttgcttcatcacaagcccagaatgaacccctaccctgcccgtttacagttgggtaaactgaatcttggaggtgctgtttgctgctcatcttggacagggaacacaggttgttcctgcttaactggcacaaatgcatgtcctctgtctggacactgcacagcccctggaagcaggcagaggaagacaagggcatccccggtgccctcgggggctgctgtgaaaagtctgtgcatcagtgcatgtcccaggcatcacacattgcctggccgtggcaggtggttggaaaagaaatggcttcctggtgggatggacccctgccatctcgattcctcaatcagctcccttctaccttgggtcagaccaactttaaaattaagaaaagatctatcctgagaaaccacagtaaatggattcagacctgca

SEQ ID NO: 140135 - DNA, 6087 bp, Homo sapiens
  Payload ID: 7480
  Gene Symbol: HEMK1
  Gene Name: HemK methyltransferase family member 1
  Uniprot ID: Q9Y5R4
  ENST ID: ENST00000232854
  CDS Start-End: 553-1569
gttcctaaacgccagctcggagcaatccccttgggctggagccaaatccctgctgtgattttaaggaagaccggcaggtccgggcccccaagggtcaaccccacacacatccccgcactttcctgtatgcaggcctgcgagcgtagagggagtggaattcacagcctccccacccatccgcaggggtctcctgggaggaacccaccagcgataggaacactgaagctgggctacggcgtccgcccgagccttttcttaaaggcgccgaccccggaagcggggcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggccgtcagtcccctgcttggtagtggtgtgggggtgcagtgtggaggaaggcacgtgagtcctcactcctggccttggataccatgggtcctggcatagagcagctcactcccagggattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactagactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcacgaggatgtgaccttgggcagatgacttcacctcactcagccttggcttctaaggctgagaaatgggacttaatgctttattttataggatgcatgtgaggagcccatgggatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcactgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccacc

SEQ ID NO: 140136 - DNA, 873 bp, Homo sapiens
  Payload ID: 7480
  Gene Symbol: HEMK1
  Gene Name: HemK methyltransferase family member 1
  ENST ID: ENST00000424388
  CDS Start-End: 417-683
ggcaggtatgcatgggaggtggggatcggaacggggtgtttcgactgcaaccgcctggagacctggccggtaccattctccatagtgcagatggggaaacagggttggagagagggggcctcatctgggtcgttaacaatgcggtgcgtagctgtgagggagtttacacttctgacttcgggccttggctcctgggacggcgcactggtgcaagagccgcttctggagtctggtggactcggggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggag

SEQ ID NO: 140137 - DNA, 5757 bp, Homo sapiens
  Payload ID: 7480
  Gene Symbol: HEMK1
  Gene Name: HemK methyltransferase family member 1
  ENST ID: ENST00000448997
  CDS Start-End: 272-538
gcgtccgagggagcgcgcgacgggccacgcacgtccgggcgtccagttcggggcagcttctccggctggtgggtgggtggggcagcctttcaggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctgggtatgaatgggatgggtctcctaggtctgtccccagcaggctcctctgctcctaatgtgtactgggcaggccctggcagaggtcagcacaggaccctcacctcgccagcccaagcagcccagaagggcaggcgccagacctgtcctgctgagcccacccatttctcccccatgtagtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggccgtcagtcccctgcttggtagtggtgtgggggtgcagtgtggaggaaggcacgtgagtcctcactcctggccttggataccatgggtcctggcatagagcagctcactcccagggattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactagactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcacgaggatgtgaccttgggcagatgacttcacctcactcagccttggcttctaaggctgagaaatgggacttaatgctttattttataggatgcatgtgaggagcccatgggatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcactgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttca

SEQ ID NO: 140138 - DNA, 634 bp, Homo sapiens
  Payload ID: 7480
  Gene Symbol: HEMK1
  Gene Name: HemK methyltransferase family member 1
  ENST ID: ENST00000443894
  CDS Start-End: 1-375
attctggaggtgggctgcggatcaggagccatctccctcagcctgctgagccagctcccccagagccgagtcattgctgtggataagcgggaagctgctatctctctgacccatgagaatgctcagagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaa

SEQ ID NO: 140139 - DNA, 1499 bp, Homo sapiens
  Payload ID: 7480
  Gene Symbol: HEMK1
  Gene Name: HemK methyltransferase family member 1
  Uniprot ID: Q9Y5R4
  ENST ID: ENST00000455834
  CDS Start-End: 228-1244
cgcgacgggccacgcacgtccgggcgtccagttcggggcagcttctccggctgggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaa

SEQ ID NO: 140140 - DNA, 17064 bp, Homo sapiens
  Payload ID: 7480
  Gene Symbol: HEMK1
  Gene Name: HemK methyltransferase family member 1
  Uniprot ID: Q9Y5R4
  ENST ID: ENST00000434410
  CDS Start-End: 297-1313
ctttccggcaggctactgggctccgcccacacacctcccggcctggttcctaaacgccagctcggagcaatccccttgggctggagccaaatccctgctgtgattttaaggaagaccggcagggtggcaaccaactatatctgaggaccagagccattttggggcaccagagcttgtgacctctccatctccacccagctgggtccaggggccactctcagcactcacctcagcagctgacatcataaagcagacttgggaacctggaagcactctggagaacctttccctgagacatggagctttggggccgaatgctgtgggccctcctgtctggcccagggaggaggggaagtacccggggctgggccttcagctcatggcaaccccaaccacctctggctgggttatccagtgccatagaactggtcagccactggactggggtctttgagaagaggggtatccctgaggcccgggaatccagtgagtacatcgtggctcatgtccttggagccaaaacatttcagagcctgaggccggcactttggacccagcccttgacctctcagcaactacagtgtatccgggagctgagtagccgtcgattgcagaggatgccggtgcagtacatccttggagagtgggacttccaggggctcagcctaaggatggtgcccccagtgtttattcctcggccagaaacagaggaactggttgagtgggtgctggaagaggtggcccagaggtcccatgctgtgggatccccaggcagccccctcattctggaggtgggctgcggatcaggagccatctccctcagcctgctgagccagctcccccagagccgagtcattgctgtggataagcgggaagctgctatctctctgacccatgagaatgctcagaggcttcggttgcaggacaggatttggatcatccacctcgacatgacctcagaaaggagctggacacacctgccctggggccccatggacctgattgtcagcaaccctccctacgtcttccaccaggacatggagcagctggcccctgagatccgcagctatgaagaccccgcggccctggatggtggggaggagggcatggacatcattacccacattctggccttggcaccccggctcctgaaagactctggtagtatcttcttagaagtggacccaaggcacccggagcttgtcagcagctggcttcagagccggcctgacctgtaccttaatcttgtggctgtgcgcagggacttctgtgggaggccccggttcctgcatatccggaggtctgggccatagcatggctgccctgtggatgccttgtcagtgccgccagcctgaccagaggggaggtggatggcactttccagagcccaggttcttatggcatttcccagggttctgtgatttccccatgctctgcatttctaggatatttctaggacacctggattggctccatcacatcagagtggctgagggcagttgctctgtgttggtgaaattgctgtgggggtatcgggggatatggccagtaaagtattgagagactaacaaatggtgacctaatgttttgtccatgacttgcaggtcccctgacccccttactcccaggtagcactggggcaagggtttccttctgccccagcagggctggccgtcagtcccctgcttggtagtggtgtgggggtgcagtgtggaggaaggcacgtgagtcctcactcctggccttggataccatgggtcctggcatagagcagctcactcccagggattgattagtcctccactgccctgggtgcatgcgtacacaattccctggccaagcctggctcgagcacaggaagctcatctgcgttttggctcaaggatgactgcctgctttctggaggggagggtctggaggtctttgctgcacagttcctgggtcgcacatccacgttcatttaactgaaggcttgagccagtgaggggtgtttcctttttatccccatagcttttagctaaaacatccctcccgagttgaccccctggggtttcaaataacccatgtgtccctggttggggctggggagagtgagaagctgagatactgggcacagggttgtggcctccaccccagctctggtctgtgcagactcatggccaccaggaggcctgcagatccagccttcctgtcaacagcgacaggaaatctctaggttggtgagtgctggtgatgtgagcctacatcagggtgggtcctaagaaacatggcaaaccaggctgtctcattccactagactgccccctgccaccctggcacttcccagggcctggcagtatggtctgatgggcagtatggtccaataggcagcatcctctgctgcagctgggagagctgagttccagggctgtgtcctgcagtgggaccttgggcaactcctttccctatgagaagctggctcttctgagtccagggccaacgccaactggcaacctctttactcttagtcaagtggaatgtgcatgctggcatctgaatgtccattcgccaggcatggagagcaagagaaggtatgtactgcctgaggtcacatgacagtgaccaagtggagacagtaagttagatccctccctttggggagcctatattgctggagtcatacccagcctaagtgttgccctgcactatggctggaggacacatttggtagaggtcacactgcagctcccagtgccccagtgtcctgccctgtgcccagccccagctgcatggactctgagctgcccctggcttcctttaaggaggctgctccagaaggaacctgggtggggagggcgaagggggtgcacaaccagggcaaggctccccacttccttagtcccccatgctcacagacctttgcctgctaaggtcctcaccagtattgccctttctgtctttctccttgtgccctttggctcttgctgtcttcagcagcatctcagggtagctgccctgacctcggagcagtctgtcgcccccctacacctcagccagtcctggcttccctgatggtctctccctcctggcctcaggcccattcctgaggaagggccttggcgagcttgtggatgttgcaccagaagagagtgcagtgttggagagtgacactgtcggggcagctggggccacaagcaggagccggcctcgggcacaactttctgcccagaaaaatgtgcagcttgactctgctgaggaaaaggtccaagccaagaggactggcaggcggggcctcaagcctgcagccactggcttgattgggccctggacgttgagcccagatgttggagccacaccagcctggatttcaatcccagaatctgcccctcacgaggatgtgaccttgggcagatgacttcacctcactcagccttggcttctaaggctgagaaatgggacttaatgctttattttataggatgcatgtgaggagcccatgggatgtgcctggcttggcacattgtggcatttttccttgccttcctcggagggcagacacagggaggaaggacccagtgccctcaggcgtccatctgatgcatgggaccaacataaggcaggcagggatacaaggcagtctggaaagaagggaaggcaggagtttcagtcttgggctcttgactcctcactgttgtctagagatggagccagcaggctggtagcctggcagcctacatctcccctcagcctctcctcactatggccccagtgccttgaggcccaggccagggcagccagtggctctagctcagggaaagccaggcccacctgccctatcccctcccttgctcctgaggccaaagccagagactcgaacagcctccccaccaccaccagcatatgtcaaggagcacttgcaggcagaatgggaggaggacatggagctgatggagtccaggctgtgcaagcccctgaggtcttgagagatgtgcccactgcccgtgcagcctccttcagccagagcccagagcatagacaggagtgtaggagtccctgtttgatgtactctgggagagtaattctatctcctcttctgatagttggggaaactgaggccttgtctcacagttggatgcttttcccagttgtcagtgggtttctccatgggtctcatacagctgccttattgaaataggccccgaaccccctaaatgcaaaaaatactcttttttgctcctttacccccacctggaccctgggctattggctgctcccaatccttgccccaaacacttagctggctccccatgacttaagtgtgttctcttgtgtcctatggaatccagttctgaagaggtgggggaggacaactgtgggaaaagccctgggggcccctcccaaggccccatcagtgctctgagtaggctgtcatcagaacaaagggctccactgctgacaaggtttgagaactgctggcttgaggtgagaacccctttaacctctgcgggacagcatgtctttccctatccaccttcgattcttttctcttttttttcttcattggctccttcttagtggattctcttctctactgccctgggcttcagcctttgtgcagtactctcgatgccctgaacacacaccttccctttgcccaggcggtgcaaacaatccacttcttcaagctccaacacaaatgctgcctcctttaggatgcctgctctgtgctctccctgcctcccctagcccatacctctgctggcaccttctgtaccatgccttcagaaaccttcttatccccctcatctctggggccccctgtggatctggcatacccaagttcagtaaatgtctatcagtaagctgatggtacatgcattttctagaatagagctgggacttcccatgtggcccacatctgacctggcagcccatgtattccggtcattagggatgggaagccatgaggacctggccttctgcccgacccaggcagccattcaagttgagcaatggccacttcgaagactcaagtgcacctgatccctgcgcaacagccacaccaggagaacaggctgtccttggcggcagtaggagcaggcgccaggtttcctggagctcttggcttcagccagcccccagccagagtcctggctaggacagtgacctgatctcctcctcatgaccttctgccctggacaagccccctgaactggatttgggactgtcaaagcaactctacccctgctctggtaggctgaacagtgaccccccaaaatggcagtgtcttaatcacctaaaccttaacatgtgactatattaccttcacatagcaaaatggactttgcagatgtgattaaggatcttgagatggaaggagtatcctggatttttcaggtaaactgagtataatcacaagggcctctgtaaaggaggcaggagtgtcagagtgacggaagaaaatgtatgtaacaatggaagcagaggtcagagtgatgcaattgctggaggaagagccatgagccgaggaatgcagacagcctcttctcctctggggcctcaagaagaatgcagtcctgccaataccttgattttaagccctgtgaaactgatttcagattgctgacctccagaacagtaagatcataaatttgtgttgttttcacatgtgtgaaaacacatgtgtgataatttgttacagcagccacgggaaacgaatatagattgtggtgcccaaattagagtgctgctgtaacacacgcctactgattgaagtggctttggaattgcaacgtggaaatgggcagaggctggaagaattttgagagtcatgataaattgccttaaccacctctcttctgataggtgatgtggccaggggaactcttcctcaaccttcagacctaaactgcccaggccccccctttttttactcatatttggagagaggtggccctttcccagagtgagaagactgaaagactgaccagcatgggtcccagaagggagtgggtgaggaatgggactgggatgtggggagaaagtgcaaggctggcctccatggcccatctccagagactgggtccagagaggacctcagagactgggaccaagcctgttcctgctctcctgtggagttatgtgactggcccaggaccccttgggtgtgtgaggatgagcaggggccctgtactctctgggttgcaggtactgcatctgtgaaatgagcacagcagcccctgactttgagctaatgggcctggcccctccatgtaagccataggcctgagcagagctgtgtcaccattctgttcctatggtggagtggggctatccctggggttctcaacctcctggttcctaaaactgaattggccaactggtgccctcagccctgtccctgtccaagctgggactaggacctccctttccaggggtactaaaggactctggagacaccatcccacccagccaaggcttggggctcctgaagccagtcctaacccaggagccacatggagagctactgggaggccagacatgggcctcatgctgggtttcagagctgagaagctgggggacagagagcatggacacctgggttcaagggtcagcttggccccaaatcacctggatacgctttggatgaagccaggagggcctgtttatactggaaggggtggatcatggcaagacttatattcaatccctgatcttttttcccagagagggatggggcttacttgaagtaacacagcacttgactcctgactcccagtatgatgctctcatctcctattgcttccaaaggcctggggttagttaattaagtcaattaggtggtgctcatatggctgtccatgtagctactaaacccagggattctggcccataaagccctctgggccaggtttatgggcaggtaagagtcacattaggccaactgtagccctgggtgtgcagacagatctgagtcccatctgaagctctggtagctgtgggaggagagcaggatttcccccgcttgcggaatgagtgggtgccttcccctctgaggtaattggctgtacagcccccagcctctgccccccagggccctcctgaggtgtctggaaggacctttgggatctttggcctcataaccagaaatcagaagcttcaaattctagaggccccttttcttccaaagactacctctcacacatacagcagtcctgcaggaaaatggtcaggaaaggctaattttacagctcacaaagtgggaaaggcagggaagcctacctcagcttcatggaaagccctgaactgggctgacctccacctgccccagctatgcctaaagggggagggtgagacagcttagagtagccatgccccgtggcaggcaggcctggctaagtggcccccttcccaggggctggggtcttccccaaacactctacctctcagagcagaggatgtcaccttattgctccctcttgtactaggtctgcggccctcttctggggcatgtggctggggaaatggtgggatcagatatcccctactgagcccagggagcagattgttggtgcctgaagcgctcacagagatccctgtggtacagatgaggaaactgaggcttagcaggacaggagcagggctggggcacgagccaggtctcttctctggctcacagctgccagtccttcctttgccacctgaagaccccccaccccacctggctttccaggaacaggcctgcctgcctggagaggcgtccaagtccctctgctgttcctggaagtcagtgtgaggctgagctacgtgaccaagcaaagcaaactaggactacaggtgtgaacaaccctgcctggctaatttttaatttttttttttttttagaaacggggtcttgctatgttgccagggctggcacatggggtttttagttgtccccacattacaaagttgaggacaccaaggctcagcagggtgcagttgcaggtcaggttgcatagctggacaggaagggaggatgaggctgccattggtgtccatttgactatcagagacgctgaggccagcataactaggtcctgggctgtcccctgcagagcttagcgcagaagttacctgggcttgtggacccttggagcaggagcaagggtttccagggctgtccctagagggctttctagaagacctgcagctgctcctgggtgcatctcctgaggtatagggccagggcctcagtctctcaagacctactttgtgtcaggcaccagggagatgataccaagtggagggtcctatagaatatggtgcatcctgcgccaagtacttccaggattatcttactcaaccttcatgacatcctcagagatggaggctgtgaaccctctcgttatactgacgaagaaacaaactggggctaagaaacttgctcataggctggctgagctgtgattctggcataggctgagtgacctggagctggaggccttagtcatcacaccaggcttgaggaggggcggataggacaggaatataccaggcagtagggacagtctggacaaaagcctggagttctgcagacatgcgggtagggatatgtaggggtgaggtggtgccgagaggtccccttggctgagctctgaatgcatttctggggaccaggggcctaaagagctttttgagctgagttacagggttagagaagcattgaggctgctctttctggctgccaggaaaaaggggctggggcaggaggctgcaacttgtccagggtctggaggtggctggggtctgtagcagtggcatcagatattctggaacagaactgactcacaaccattgctgagggtttggatgtgagatggccaggaccacagtgggcccagggatctgattgggacctgggggaaatggggccaccctgagttggagactggggtgctggggggaacagtcggggagcttgacagtgtaggatgccttcagaatatccgagaagcagcattggggcgtctggagatgcaaatgtgaccatgtggggacacagtccaaaggcaacccttgaggtagagttgtgaagaccactctcctagacctgagtgctggcgacaacagtaccgggcatctgcagtgtgtaaactagtgccaggtgctgcacacacgtggtcataaatccatctgttggcacatcagggatcccttccttggcccactgtatggatgaagggactgaggcttaacatgcccaaggtcacacagccagcagctggccatgctggagtttgaacctagtcctctgacatcccagtcaggagaggcgtgagcaggctgccgaggccaaatgcagcccagggcctcaaccccccagaggggcctcaggagccagttaggtgccccacagccaacgtgggctccagggtgaaggggaaagtgatgaatcaaacagaaagcagcagacgcagactgagctctctccctgtcggcccgggtgccagattttcacgcccacagcaaaggggccaggcagagcgctaggtgtggggcaggagagggcagcgaaagtggctgccactgaacccagactctgatgtactccggatatgggtggcgtggactgacagacacccagcccagttccagactgaaagttgagtctgtctcagcatgtgaggatatgaagtttgccttgtcatggggagcatttcaggtccctaggcctgtgaggttctgggatgaggcaccagatggatgtgtctaaaaacccttgttgaaggcactccacagctcaataactgaccattgctcactactctcttggcccgcactgaaagccactgtttcttcatcatttcactcagcccgcctgtctcagccccccagaactttggagctcattctttcaaagtacatttcatgtgcaactgaaatacatatttttaaaaagataaaatgagcatctagttagcaaaaatgtattttgcaagtgcaaattctttcttagcatacagtccatcagggcgaagagcaatgaacacaaatgtttgaactgggggctgggatggtagttgtagtcttatgttggtctcaatgtccattttctttcagtgtttgattttggtagcacaggacaaagtgaccgctgattctcacagataattgtttacaaatgctagcactgtgtctgaagcccaccttgcagtctctttgattgacagggacagcaagagaagccttatctcaagctcagcacaaaccctgttctctgagcacataggaaggattctaatgtgtcataatttggtgctgtgcccatttgagtctgtgtgtggtttttaaaattgggttttttttttttcaataattaaaaatatgagctgggcatggtggcacatgcctgtggtcccacctactcgggaggctgaggcaggaggattacttgagcacaagagtttaagacagcagtgagctataatagcgccactgcactccagcctggacatcagagtcagaccctgtctctaaaaaaataattttaggccgggcgcggtggctcacgcctgtaatcccagcactctgggaggctgaggcaggcagatcacctgaggtcaggagttcgaggccagcttggccaacatggtgaaaatccgtctgtactaaaaatacaaaaattagccgggtgtggtggctcacgcctgtaatcccagctacttgagaggctgaggcaggagaatcgcttgaaaccgagaggcagatgttgcagtgagccaagatcacgccattgtactcccacccaggcaacaagagcaaaactctgtctcaaaaataataataataggccaggcgcagtagctcacgtttgtaatcccagcactttgggaggccaaggatcacaaggttaggagttcaagaccagcctggccaacacagtgaaaccccgtctactaaaaatacaaaaattagctgggtgtggtggtggacacctgtaatcccagctactcgggaggctgaagcaggagaattgcttgaacccgggaggcagagattgcagtgagccaagatcatgccactgcactccagcctgggcgacagagctagactccatctcaaaaaaaaaaatttaaaaataataattttaaaaaaatgttttaaaaatgaaagaaaaggaagaagggaggaggaagccagaaagaaaggggccgtgcagggtggctcacacttgtaatcccagcactttgggaggctgaagcaggcagatcacccgagctcaggagttcaagaccagcctggccaacatggtgaaaccctgtctctactaaaaatacaaaaattagctgggcatggtggctcatgcctgtaattccagctactcgggaggctgaggcaggagaatcgcttgaacccggaaggcggaggttgcagtgagctgagatcacctcactaccctctagcgtgggcgacagcaagactgtttcaaaaaaaaaaaagaggaagagtgaaaggatggacgaaaggaactcctgtggggtggggcatctggggcacttgatgccccacgtgaccattcccttcccggaggtctgccccaactgctccagcccccatagcctgaggctcccggcacctcccacccagcatctgtcacagcaaatcaatctgggccacatgctcctgaaaggtccttgggagccccaccaggctccagtgtggttgccccaagtactccatgagtagacatgggctagggacttacccaggcccttggtggtgcctccaagggtggaaagactgggggaccctgtgcccctgaaagcccagagtttcactgtttctgggtaccttcatttctgggaactaactgtgctttggaaagagagaaatgagaagcaaaaccctagggccccagtatcacccctcctttctgtcttccttccgcttagtcacagccaagagctcagtacctcagcctcccttagggccactaggtggggcagaatacaaggtcaggcgaggacacagcatctgggacgagtcctttcctgccaacagcctccgtgaggggtcctaggattgctgagggctgagaccaccttcccaaagttggggaaggggtaactgaggctgtcatctggcctgtctcacctgtcttacctgcaggcccatcattcctgcacagtcatttattaggcaccaactgtaagccaggcccaggaggttggatggttcaggtggggccctggccttgcagaactcatggacttgcacatagactcctcctgacaggcccctcatgagtagctgggtccttacgatttttctggtcagcagtggggagccgtgggaggcattaggctctggggaagccaagcaacatcacatgtacacagcatagagactcacacacccttgcacaggcacccacacgtacgtgtatgttcatgggcgtgggccttgagcaccgggtcccgtgagccactgcacctggccaactgggtccatgtccataatcataggtgtccacgcagggcctcccttggatgggggagctccaggctctggaaaccaagccagggttgcatgcatgcacgtgtgtgtgtgtgtgtgtgtgtgtgtgtgtgtgtttgtgtgtgtgtggtgttactctgcctcagaggcccaaccactgcctccaagtcatgggagcgcagagcccatgtaagctcaaacactgccccatgtcatagaaaagagggccaaagatggggctgggcgtggtggctcactcctgtaatcctagcactttgggaggctgagtcgggtggatcacgaggtcaggagatcgagaccatcctgactaacacggtgaaaccctgtctctactaaaaatacaaaaaaattagctgggcgtagtggcgggtgcctataatcccagctactcaggaggctgaggcaggagaatggcctgaacccgggaggcggagcttgccgtgagcggagattgcaccactgcactccagcctggacgacagagtgagactccgcatcagaaaaaaaaaaaaaagaaagaaaagagagccaaagctcagagagggcccatgacttgcccagtgtcacacagcaaggtgaggcaggtctgggagggaaatgaaccagaccttatccacatccctgacctttttggcttcatgcttggagcttggcaccccctgagaaccacactccgttgacctctgggaaatggaggctggtgattctcccagcaaacccgcctgggaactaaccacaggctcctcccagctttcactaaccaaccccaggatttccaataccggtgctttgcttagctgtactgggcacctggaactcattctccctgccaccctccctccctgattccttgaataaaattcagccttccaaattttactcaaatgcttctactttctctgaccctctggaactttcccctgttgccagcctccctccagcatctgtcccctcattcccacctcctgtttacttccctacaaaagccaaaaattgacccctagagcctgagactctggatggaggatcttcgtagctggggccacacccaggccagcccagcccttcagactctgccagtcacagtggggtgggccctggagctggaagaggaaacagagcctctgccagagtcaccacctgcccccaaccctacttctcctccgaaggcccaacaaggtcctgtgcgccctccaagggcagaggaggctgctggctgtggctgtgggaggagacctggagcactgtgcccgaggcaaagctggccccgtggagtttgctattccagcttttatttactcctctgtaccctgagcaccatcaactgggtgccaggcctgtgcctatatttggcagggtgaggggtgggggccagacaaattgtagaggagcctcaggtctttggggtgttgcccctccactacatggccccagaccaagttctctgccagtttgcagagctcttcccttccacttggtcttgaggaggggccagagaggctgcctttaccccatgagctctgaaccctctcactatctggctgtcccctcattctctcaccacccactcccactcccgatgggagcctcaggcctggcttaggaaccctgcccacagctgtactaatgcccttggctttgctatagggaaagaacacagccactccacactctgggacagccagcttgcgtccatcccctagtgcagagggctagtttagggaaggacattaggaccctgactgtgcacctgactcaggggccccggagaagatttggtgggctaagggtgggcaggagaatacaactcacagccaagcggaaggtggctttcagctccccccttctcattttttcttactgtggctgcaccagggctgtgcccctcatggaaggttcactttcctgcttatctagtctcagatgttacagtttttcttgttatgtattatacagagagatggcctaactggttcttgctgctgcatgggcaagccattaatttacaggggtttatcttataactggacacctttttgttttctcttacaagatgtgcttgttgttgcttctcttggattttctacattgacattttaccactgaaaataatgacaatgacaaatttgtcttttcctttctttcttttttttttttttgagacaaagtgccactctgttgcccagactggagtgcagtggcgcgatctcccaggttcaagcgattctcttggctcagcctcccgagtagctgggattacaggcgtccaccaccatgccaggctaattttttttttgtattttcagtagagacggggttttgccatgttggccaggctggtctcgaactcctgacctcaagtgatctgccacctcggcctcccaaaatgctgggattacaggcctgagccaccacacccggcctgtcttttcctttttaatacttatggctcttatttattttccttgtttaatagcttggctgagaccttcaatacaatattgaaaaactgtaacgactagagcatttgtatattgtttctcacttggggtgcctctggtccctccctgtcaagtgcacttgctattgattttggatagatggcccttttctacttaaaaatggttcagtctagttctggctgactctgattttttgtttattttagaggctttttttttcatctttcattcatgcaacagaccttcagtgagctgattgccaggactacactgtcatactgtggtaccaaagaaaaattgacacggtccctactcataaggagttcatggcctggtggaggatacaggcaggcaaatagatccttatccttaggccatggggcatgcattcagtcaccatctgctggcactgtgccaggcacaaggaatgggcactattcaggcaggcccccatcacagtctggtggggtccaagcagttcacatcccctctcactcaagttcccacagagtagttgcaatggtgagctgaggttttctctgctgcagaggccaggtgggtaagtaaccaaaagtgcctgagagctaatcccctggagcagcctgaaaccaaggaagacagagagttggtagacacatgcccagctccctcaccccttgggtgggacaaccgtggcttgtgttttctgccagctcccaactgaagactgagcctcagttgcctacagaaggaacccactcataaacccacctacctcctttggcttcctttccttccctgtctcaccccctctcccattttatatcaataagtgtgaaggctgagattttatccgactttctttttttttttttgagacagagtctcattctgttgccaggctggagtgcagtggcgtgatcttggcttactgcaacctctgcctcccaggttcaaacgattctcctgcctcaggctcccgagtactgggactacaggtgcgcaccaccacacccagctattttgtatttttagtagaaacagggtttcaccatgttggccaggatggtctcaatctcttgacctcatggtctgcccacctcggcctcccaaagtgctgggattacaggagtgagccaccgcgcccggcttatccgactttgaagcaaacaagttagtctatcatagtctatcatattctcaaggatcatggcagaaggcacagaactctgggttcagaaacagacaacagattattgtttacagtaacggcagtagacagagtaaaagcattttcttgcaccacttccctgaaccgcagttcctacagagtgatgtgatgatggcccggtgatgcctgcatatgcattgggttgcactacggtggagaaactgcatgctgaatttaggggacccacgtcttttataataagctgcaagcaaacctgcccaggtgggagatgttatctttagtatacgggacaataaaatctgccttttgctctggagggagatactacctctatcttctaaggttactcactataataatcacccttgtaaagattatttagaacaagggcaaccagtgcctctactggcaagtgtgcagaaataggagagaaccatggggaattgtctctcaataccttactggtgcttcttggcattacttcccaaataatctatttgcatttggatgcttgtctcagagtggtttctgcaggaaaaaacccaagatagagagacaacactatataggcatcgatgtatttctggggtgactctctttcctccagacctctcctgcaaacaacgcaggggagccacgcaaaggaagaggtttccacacctgggattgatactgctgggactccagggcaggtgctctaaaggactcttagaatttcatttttaatgtttaatatttggtccatctagaatttatggtggaaggtgtgaggtagacgttgcacttttttttccttccaaattgctccaatatcacttactggaaattgtgctttgtctgttaccactctcttctaatctgcctgtggcctgttccttagagtgtatcacaaacatacaagtgatcaatttccaataaattgattaaagaatt

SEQ ID NO: 140141 - DNA, 1704 bp, Homo sapiens
  Payload ID: 7481
  Gene Symbol: HFE
  Gene Name: hemochromatosis
  Uniprot ID: Q30201
  ENST ID: ENST00000349999
  CDS Start-End: 161-943
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatg

SEQ ID NO: 140142 - DNA, 1158 bp, Homo sapiens
  Payload ID: 7481
  Gene Symbol: HFE
  Gene Name: hemochromatosis
  ENST ID: ENST00000309234
  CDS Start-End: 3-1016
aaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttg

SEQ ID NO: 140143 - DNA, 809 bp, Homo sapiens
  Payload ID: 7481
  Gene Symbol: HFE
  Gene Name: hemochromatosis
  Uniprot ID: Q30201
  ENST ID: ENST00000353147
  CDS Start-End: 161-667
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgctgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttc

SEQ ID NO: 140144 - DNA, 1922 bp, Homo sapiens
  Payload ID: 7481
  Gene Symbol: HFE
  Gene Name: hemochromatosis
  Uniprot ID: Q30201
  ENST ID: ENST00000317896
  CDS Start-End: 161-931
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcac

SEQ ID NO: 140145 - DNA, 653 bp, Homo sapiens
  Payload ID: 7481
  Gene Symbol: HFE
  Gene Name: hemochromatosis
  Uniprot ID: Q30201
  ENST ID: ENST00000352392
  CDS Start-End: 161-391
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctaga

SEQ ID NO: 140146 - DNA, 804 bp, Homo sapiens
  Payload ID: 7481
  Gene Symbol: HFE
  Gene Name: hemochromatosis
  Uniprot ID: Q30201
  ENST ID: ENST00000336625
  CDS Start-End: 45-773
aagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaagga

SEQ ID NO: 140147 - DNA, 1280 bp, Homo sapiens
  Payload ID: 7481
  Gene Symbol: HFE
  Gene Name: hemochromatosis
  Uniprot ID: Q30201
  ENST ID: ENST00000397022
  CDS Start-End: 161-1138
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttc

SEQ ID NO: 140148 - DNA, 5286 bp, Homo sapiens
  Payload ID: 7481
  Gene Symbol: HFE
  Gene Name: hemochromatosis
  Uniprot ID: Q30201
  ENST ID: ENST00000357618
  CDS Start-End: 123-1169
ttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgagtgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaagcattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtatattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaa

SEQ ID NO: 140149 - DNA, 777 bp, Homo sapiens
  Payload ID: 7481
  Gene Symbol: HFE
  Gene Name: hemochromatosis
  ENST ID: ENST00000485729
  CDS Start-End: 1-168
attgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaa

SEQ ID NO: 140150 - DNA, 1123 bp, Homo sapiens
  Payload ID: 7481
  Gene Symbol: HFE
  Gene Name: hemochromatosis
  ENST ID: ENST00000470149
  CDS Start-End: 50-1087
cccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagaaggaagtgaaagttccagtcttcctggcaaggtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaa

SEQ ID NO: 140151 - DNA, 781 bp, Homo sapiens
  Payload ID: 7481
  Gene Symbol: HFE
  Gene Name: hemochromatosis
  Uniprot ID: Q30201
  ENST ID: ENST00000488199
  CDS Start-End: 37-777
gagatttaacggggacgtgcggccagagctggggaaatgggcccgcgagccaggccggcgcttctcctcctgatgcttttgcagaccgcggtcctgcaggggcgcttgctgcagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacg

SEQ ID NO: 140152 - DNA, 1045 bp, Homo sapiens
  Payload ID: 7481
  Gene Symbol: HFE
  Gene Name: hemochromatosis
  Uniprot ID: Q30201
  ENST ID: ENST00000461397
  CDS Start-End: 37-1041
gagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacg

SEQ ID NO: 140153 - DNA, 2234 bp, Homo sapiens
  Payload ID: 7482
  Gene Symbol: HFE2
  Gene Name: hemochromatosis type 2 (juvenile)
  Uniprot ID: Q6ZVN8
  ENST ID: ENST00000336751
  CDS Start-End: 345-1625
ggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacatcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatgctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 140154 - DNA, 2123 bp, Homo sapiens
  Payload ID: 7482
  Gene Symbol: HFE2
  Gene Name: hemochromatosis type 2 (juvenile)
  Uniprot ID: Q6ZVN8
  ENST ID: ENST00000357836
  CDS Start-End: 575-1516
atattctttctaatcctctaaccctccccactcccccaactcccacaccctacccccaccaacgttcctggaattttggacttagctatttttaaaaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacacca

SEQ ID NO: 140155 - DNA, 536 bp, Homo sapiens
  Payload ID: 7482
  Gene Symbol: HFE2
  Gene Name: hemochromatosis type 2 (juvenile)
  ENST ID: ENST00000421822
  CDS Start-End: 257-536
cttctctggttccctgacctcagtgagacagcagccggcctggggacctgggggagacacggaggaccccctggctggagctgacccacagagtagggaatcatggctggagaattggatagcagagtaatgtttgacctctggaaacaccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatgctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccg

SEQ ID NO: 140156 - DNA, 1419 bp, Homo sapiens
  Payload ID: 7482
  Gene Symbol: HFE2
  Gene Name: hemochromatosis type 2 (juvenile)
  Uniprot ID: Q6ZVN8
  ENST ID: ENST00000497365
  CDS Start-End: 208-810
cttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 140157 - DNA, 1381 bp, Homo sapiens
  Payload ID: 7482
  Gene Symbol: HFE2
  Gene Name: hemochromatosis type 2 (juvenile)
  Uniprot ID: Q6ZVN8
  ENST ID: ENST00000475797
  CDS Start-End: 170-772
ttctctggttccctgacctcagtgagacagcagccggcctggggacctgggggagacacggaggaccccctggctggagctgacccacagagtagggaatcatggctggagaattggatagcagagtaatgtttgacctctggaaacactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 140158 - DNA, 506 bp, Homo sapiens
  Payload ID: 7482
  Gene Symbol: HFE2
  Gene Name: hemochromatosis type 2 (juvenile)
  ENST ID: ENST00000634927
  CDS Start-End: 239-451
cttctctggttccctgacctcagtgagacagcagccggcctggggacctgggggagacacggaggaccccctggctggagctgacccacagagtagggaatcatggctggagaattggatagcagagtaatgtttgacctctggaaacatcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatgctcattctcaatgcaagatcctccgctgcaatgctgactcaccatcatatttaagaacatgcaggaatgcattgatcagaaggtgtatcaggctgaggtggataatcttcctgtagcctttgaagatggttctatcaatggaggtgaccgacctgggggatccagtttgtc

SEQ ID NO: 140159 - DNA, 2192 bp, Homo sapiens
  Payload ID: 7483
  Gene Symbol: HEMGN
  Gene Name: hemogen
  Uniprot ID: Q9BXL5
  ENST ID: ENST00000259456
  CDS Start-End: 145-1599
cggcagacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaa

SEQ ID NO: 140160 - DNA, 2305 bp, Homo sapiens
  Payload ID: 7483
  Gene Symbol: HEMGN
  Gene Name: hemogen
  Uniprot ID: Q9BXL5
  ENST ID: ENST00000616898
  CDS Start-End: 258-1712
ataaatagcaacctatgctaggggttgctagcaccagccatttcccctactcacacctgtgcagtgtgataaagatagtagaattagcctgcagttgtggtccaaccagataaaacttttaggcgggaagtcaagtgacaggcaaacttgtgtgtgtggtttttttttttaagtgttagatgtttttgatattttaaaaaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaa

SEQ ID NO: 140161 - DNA, 577 bp, Homo sapiens
  Payload ID: 7484
  Gene Symbol: HBA1
  Gene Name: hemoglobin, alpha 1
  Uniprot ID: P69905
  ENST ID: ENST00000320868
  CDS Start-End: 38-466
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggca

SEQ ID NO: 140162 - DNA, 504 bp, Homo sapiens
  Payload ID: 7484
  Gene Symbol: HBA1
  Gene Name: hemoglobin, alpha 1
  ENST ID: ENST00000397797
  CDS Start-End: 61-393
gagagaacccaccatggtgctgtctcctgccgacaagaccaacgtcaaggccgcctggggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggca

SEQ ID NO: 140163 - DNA, 605 bp, Homo sapiens
  Payload ID: 7485
  Gene Symbol: HBA2
  Gene Name: hemoglobin, alpha 2
  Uniprot ID: P69905
  ENST ID: ENST00000251595
  CDS Start-End: 67-495
cataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagca

SEQ ID NO: 140164 - DNA, 513 bp, Homo sapiens
  Payload ID: 7485
  Gene Symbol: HBA2
  Gene Name: hemoglobin, alpha 2
  ENST ID: ENST00000397806
  CDS Start-End: 71-403
cacagactcagagagaacccaccatggtgctgtctcctgccgacaagaccaacgtcaaggccgcctggggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagca

SEQ ID NO: 140165 - DNA, 628 bp, Homo sapiens
  Payload ID: 7486
  Gene Symbol: HBB
  Gene Name: hemoglobin, beta
  Uniprot ID: P68871
  ENST ID: ENST00000335295
  CDS Start-End: 51-494
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 140166 - DNA, 502 bp, Homo sapiens
  Payload ID: 7486
  Gene Symbol: HBB
  Gene Name: hemoglobin, beta
  ENST ID: ENST00000380315
  CDS Start-End: 231-502
ttggaaaagcaacccctgccttgaagccaggatgatggtatctgcagcagttgccaacacaagagaaggatccatagttcatcatttaaaaaagaaaacaaaatagaaaaaggaaaactatttctgagcataagaagttgtaggaaggttttaatccaaataaggagaagatatgcttagaaccgaggtagagttttcatccattctgtcctcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtga

SEQ ID NO: 140167 - DNA, 609 bp, Homo sapiens
  Payload ID: 7486
  Gene Symbol: HBB
  Gene Name: hemoglobin, beta
  ENST ID: ENST00000633227
  CDS Start-End: 51-218
acatttgcttctgacacaactgtgttcactagcaacctcaaacagacaccatggtgcatctgactcctgaggagaagtctgccgttactgccctgtggggcaaggtgaacgtggatgaagttggtggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattg

SEQ ID NO: 140168 - DNA, 486 bp, Homo sapiens
  Payload ID: 7487
  Gene Symbol: HBD
  Gene Name: hemoglobin, delta
  ENST ID: ENST00000292901
  CDS Start-End: 51-476
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgtgtaagaaggttcctgaggctctacagatagggagcacttgtttattttacaaagagtacatgggaaaagagaaaagcaagggaaccgtacaaggcattaatgggtgacacttctacc

SEQ ID NO: 140169 - DNA, 785 bp, Homo sapiens
  Payload ID: 7487
  Gene Symbol: HBD
  Gene Name: hemoglobin, delta
  Uniprot ID: P02042
  ENST ID: ENST00000380299
  CDS Start-End: 216-659
atgacagaacagccaatctcagggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaa

SEQ ID NO: 140170 - DNA, 566 bp, Homo sapiens
  Payload ID: 7487
  Gene Symbol: HBD
  Gene Name: hemoglobin, delta
  ENST ID: ENST00000429817
  CDS Start-End: 254-566
attgtggcattatttgaattcagaaaagagtgaaaaactactgggatcttcattcctgggtctaattccacatttttttttaagaacacatctgtaaaaatgttctgtactagcatattcccaggaacttcgttaaatttaatctggctgaatatgggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttca

SEQ ID NO: 140171 - DNA, 305 bp, Homo sapiens
  Payload ID: 7487
  Gene Symbol: HBD
  Gene Name: hemoglobin, delta
  ENST ID: ENST00000417377
  CDS Start-End: 51-305
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaaga

SEQ ID NO: 140172 - DNA, 827 bp, Homo sapiens
  Payload ID: 7488
  Gene Symbol: HBE1
  Gene Name: hemoglobin, epsilon 1
  Uniprot ID: P02100
  ENST ID: ENST00000292896
  CDS Start-End: 269-712
agatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagt

SEQ ID NO: 140173 - DNA, 913 bp, Homo sapiens
  Payload ID: 7488
  Gene Symbol: HBE1
  Gene Name: hemoglobin, epsilon 1
  Uniprot ID: P02100
  ENST ID: ENST00000380237
  CDS Start-End: 346-789
gccatggttgtgaggcctccccagctatgtggaactagacttcaagaagttaagcaacttgctcaagatcatctaagaaatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagtaatcaaaaa

SEQ ID NO: 140174 - DNA, 578 bp, Homo sapiens
  Payload ID: 7488
  Gene Symbol: HBE1
  Gene Name: hemoglobin, epsilon 1
  ENST ID: ENST00000396895
  CDS Start-End: 316-578
cttgcttctcctggccatggttgtgaggcctccccagctatgtggaactatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaa

SEQ ID NO: 140175 - DNA, 808 bp, Homo sapiens
  Payload ID: 7489
  Gene Symbol: HBG1
  Gene Name: hemoglobin, gamma A
  Uniprot ID: P69891
  ENST ID: ENST00000330597
  CDS Start-End: 89-532
gaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgt

SEQ ID NO: 140176 - DNA, 369 bp, Homo sapiens
  Payload ID: 7489
  Gene Symbol: HBG1
  Gene Name: hemoglobin, gamma A
  ENST ID: ENST00000632727
  CDS Start-End: 33-125
gaggttatcaataagctcctagtccagacgccatgggtcatttcacagaggaggacaaggctactatcacaagcctgtggggcaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccct

SEQ ID NO: 140177 - DNA, 602 bp, Homo sapiens
  Payload ID: 7490
  Gene Symbol: HBG2
  Gene Name: hemoglobin, gamma G
  Uniprot ID: P69892
  ENST ID: ENST00000336906
  CDS Start-End: 84-527
ataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgc

SEQ ID NO: 140178 - DNA, 694 bp, Homo sapiens
  Payload ID: 7490
  Gene Symbol: HBG2
  Gene Name: hemoglobin, gamma G
  ENST ID: ENST00000380252
  CDS Start-End: 194-607
ggccatggttgtgaggcctccccagctatgtggaactgtaagtccggtaaacctctttcttttataaattgcccagtctcgggtatatcttcattagcagcgtgaaaacggacaaatacagcttcagtttcccctcactccactccccattaggggatagtttttgtccagattaaagaaaaacctattgtttatggtggtgctaggggaaatgaagaggaaagtcttgcctctccattttcttccgttcatgaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcaca

SEQ ID NO: 140179 - DNA, 1772 bp, Homo sapiens
  Payload ID: 7490
  Gene Symbol: HBG2
  Gene Name: hemoglobin, gamma G
  Uniprot ID: P69892
  ENST ID: ENST00000380259
  CDS Start-End: 1242-1685
gaatgtatccagagaatcaacatacaatgagcaaaagtgaagcttttcctagacttgaccctcatcaaatctcctctgtccccactctcttctgaagaaggaaaggctggagtacaatggcgagatcttggctcactgcaacctccacctcctgggttcaactgattctcctgcctcagcctcccgagtagctgggactacaggcatccgccaccacacccggctaatttttgcatttttttagtagagacacagtttcaccacattggccaggctggtcttgaactcctgatctctggtgatcttcctgccttgtcctccctaagtgctgggattacaagcgtgaaccaccgcgcctggtctgatgaatacatgtaaagcttattgagcctcagaactctaactacagggtttcaatagcacagaaactctgagaagaaaaagaatgtcaaagttcctccctaaggagactgattagatgcaagtgtgtccggaattggtgggttcttggtctgacttcaagaatgaagccgcggaccctcacggtgagtattacagttcttgaagactgcgtgtccagagtttgttccttctgatgttcagatgtgtttggagttttttccttctggtgggttcgtggtctcgctagctcaggagtgaagctgcataccttcgcgtcctaggacagaatatggatgctgaaaaatgattctttcaaagtgctgagttgttgcctcacgcccagttgtctggcatctcttcactgaaactattacagttagatctcatctctatgggtggaaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcaca

SEQ ID NO: 140180 - DNA, 582 bp, Homo sapiens
  Payload ID: 7490
  Gene Symbol: HBG2
  Gene Name: hemoglobin, gamma G
  ENST ID: ENST00000620888
  CDS Start-End: 54-497
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatc

SEQ ID NO: 140181 - DNA, 307 bp, Homo sapiens
  Payload ID: 7490
  Gene Symbol: HBG2
  Gene Name: hemoglobin, gamma G
  ENST ID: ENST00000444587
  CDS Start-End: 14-106
tagtccagacgccatgggtcatttcacagaggaggacaaggctactatcacaagcctgtggggcaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgct

SEQ ID NO: 140182 - DNA, 506 bp, Homo sapiens
  Payload ID: 7491
  Gene Symbol: HBM
  Gene Name: hemoglobin, mu
  Uniprot ID: Q6B0K9
  ENST ID: ENST00000356815
  CDS Start-End: 21-446
agagcacgtcaggcggcgccatgctcagcgcccaggagcgcgcccaaatcgcgcaggtctgggacctgattgcgggccacgaggcgcaattcggggcggagctgctgctcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctg

SEQ ID NO: 140183 - DNA, 536 bp, Homo sapiens
  Payload ID: 7492
  Gene Symbol: HBQ1
  Gene Name: hemoglobin, theta 1
  Uniprot ID: P09105
  ENST ID: ENST00000199708
  CDS Start-End: 35-463
ggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagc

SEQ ID NO: 140184 - DNA, 755 bp, Homo sapiens
  Payload ID: 7493
  Gene Symbol: HBZ
  Gene Name: hemoglobin, zeta
  Uniprot ID: P02008
  ENST ID: ENST00000252951
  CDS Start-End: 224-652
ggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaa

SEQ ID NO: 140185 - DNA, 1652 bp, Homo sapiens
  Payload ID: 7494
  Gene Symbol: HPX
  Gene Name: hemopexin
  Uniprot ID: P02790
  ENST ID: ENST00000265983
  CDS Start-End: 102-1490
cattcccagtagagttggaggtgggggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaa

SEQ ID NO: 140186 - DNA, 826 bp, Homo sapiens
  Payload ID: 7494
  Gene Symbol: HPX
  Gene Name: hemopexin
  ENST ID: ENST00000615166
  CDS Start-End: 62-826
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtatatgcgctgtagcccacatctag

SEQ ID NO: 140187 - DNA, 1717 bp, Homo sapiens
  Payload ID: 7495
  Gene Symbol: HENMT1
  Gene Name: HEN1 methyltransferase homolog 1 (Arabidopsis)
  ENST ID: ENST00000370031
  CDS Start-End: 172-1446
tccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctagacagggtctcactatgttgcccaggctggtcttgaacttccatcctcaagcaatcctcctgccccatcttcctaaaatgctgagattacaggtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 140188 - DNA, 1874 bp, Homo sapiens
  Payload ID: 7495
  Gene Symbol: HENMT1
  Gene Name: HEN1 methyltransferase homolog 1 (Arabidopsis)
  Uniprot ID: Q5T8I9
  ENST ID: ENST00000370032
  CDS Start-End: 422-1603
gtttttaggcctttgccacgcctcgggagcgccacgaactcaacagccgcccaagccgccttccggctcgcggtctgcggacgcgctcggagttgggggccttcgccaacagctgccgtaccgtgccgcgtcgcagccgcacgctagcggggtcaacggcgcggcaggcgcaggggtcctcgccaaggttcggaagaggaccttgaaaatggcttctgggcatgcgccacagcggccgttacgagacgcaaaaccgacgccttggaactgagagcctagagggacggagctcggcgcaccatgaggctcccggggcccaaggccgaccgtgagagcgcacgagctgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaa

SEQ ID NO: 140189 - DNA, 1696 bp, Homo sapiens
  Payload ID: 7495
  Gene Symbol: HENMT1
  Gene Name: HEN1 methyltransferase homolog 1 (Arabidopsis)
  Uniprot ID: Q5T8I9
  ENST ID: ENST00000402983
  CDS Start-End: 239-1420
agcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggaccagtcttcacagaggttgagaaggccaagatagagaactctcccacacccttctgtgttggagataaatttttcgtacctctgcagagactccttgcgtatcccaagttgaaccgcttatgtgctaatgaagagatgatgagatcagtcattgctgactcaattcctctgagcagtgatggttctgcagtggtggctgacctgcgtaattattttgatgaacagtttgagttttgaaccatgtttatttcctgaaatttcagggtctcagcgatagttgtgctcacttagaatttagttttttttgtgtaatcctaattcaagtaatgtttttaaagtttcactgcaaaagtctatgttccaagccattggacagacctgcttgagatatggccagactgcagtgagccctgagaaagatatgagggtttaaaacgggtgctttcctttgattttggacttttttgttttctcaagaataaagaagttggatgtggtaatatgttaattttg

SEQ ID NO: 140190 - DNA, 1244 bp, Homo sapiens
  Payload ID: 7495
  Gene Symbol: HENMT1
  Gene Name: HEN1 methyltransferase homolog 1 (Arabidopsis)
  ENST ID: ENST00000420055
  CDS Start-End: 297-1244
ggcgagccccgcggggaggccgaggcgcgggtgcgggcgccggcgtagccgcggcggtagcgtcacgcagcgaggccgtgcgtgcgcgggcgtcagggcggcgctgagttgaggacgctggcggctccgcgacgagctttgttttttcggttgggcatgctgcttaccgcaggatgatggaagcgacggcccgtacaaagacagaagcgttggtttcactgagtcagtgctgattctctcaaatagagcttgaaggataaatcttcatttttgtttcaacaaaacttcgaaacaaaatggaagaaaataatctacagtgcagtagtgtggttgacggtaattttgaagaagttcccagggagacggcaattcagtttaaacctccactatacagacagcggtaccagttcgttaaaaatttagtggatcaacatgagcctaagaaggttgcagacctgggatgtggtgatacttcactcttaaggctgctaaaagtcaatccatgcattgaattgcttgttggagtagatattaatgaggataaattacgatggagaggggattcgttagctcctttcctgggggattttctgaaacctcgggatctgaatttgaccatcacattgtatcatggctccgttgtggagagagactctcgtttgcttggatttgacttgataacgtgtattgaattaatagaacatttggattcaggtgatctggccagatttcctgaagtggtatttgggtacctgtctccatccatgattgtcatcagcacaccaaactctgaattcaatcccctgtttccatcagtgaccttaagagattcagatcataaatttgagtggaccagaatggagtttcagacctgggctttatatgtggcaaatcgctatgattactctgtggagtttactggtgtcggggaaccaccagctggagctgagaatgttggatactgtacccagataggaatcttccggaaaaatggaggaaaggcaacagaatcatgtctttcagagcagcatgatcagcatgtttataaagctgtttttaccacctcatacccaagcttacagcaggaaaggttctttaaacttgtgttggttaatgaggtgtcccaacaagtggaaagcttaagagtgagccacctgccaaggcggaaagaacaggctggggaacggggtgataagcccaaagacattggtggctcaaaggcccctgtcccatgctttggacca

SEQ ID NO: 140191 - DNA, 2122 bp, Homo sapiens
  Payload ID: 7496
  Gene Symbol: HEPACAM2
  Gene Name: HEPACAM family member 2
  Uniprot ID: A8MVW5
  ENST ID: ENST00000341723
  CDS Start-End: 89-1441
gaatagtcagtacctagaagccactcttctttgaaaaggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgctttta

SEQ ID NO: 140192 - DNA, 2148 bp, Homo sapiens
  Payload ID: 7496
  Gene Symbol: HEPACAM2
  Gene Name: HEPACAM family member 2
  Uniprot ID: A8MVW5
  ENST ID: ENST00000394468
  CDS Start-End: 79-1467
acctcactgctaatttccctagcaaataaaccagcagctgctggtccaagttaccactgagaacagggcactgcatgcatgggacaggatgctttcatggagcccttcggtgacacacttggggtctttcagtgcaaaatatacctccttctcttcggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgctttta

SEQ ID NO: 140193 - DNA, 2060 bp, Homo sapiens
  Payload ID: 7496
  Gene Symbol: HEPACAM2
  Gene Name: HEPACAM family member 2
  ENST ID: ENST00000440868
  CDS Start-End: 52-1419
ggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgctttta

SEQ ID NO: 140194 - DNA, 1869 bp, Homo sapiens
  Payload ID: 7496
  Gene Symbol: HEPACAM2
  Gene Name: HEPACAM family member 2
  Uniprot ID: A8MVW5
  ENST ID: ENST00000453812
  CDS Start-End: 24-1481
actgagaacagggcactgcatgcatgggacaggatgctttcatggagcccttcggtgacacacttggggtctttcagtgcaaaatatacctccttctcttcgatattgttgcaaactgtttactgcttcgttttaagttatctgtctcatcttatgaaatatggaagaaaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtgga

SEQ ID NO: 140195 - DNA, 8031 bp, Homo sapiens
  Payload ID: 7497
  Gene Symbol: HS3ST1
  Gene Name: heparan sulfate (glucosamine) 3-O-sulfotransferase 1
  Uniprot ID: O14792
  ENST ID: ENST00000002596
  CDS Start-End: 1176-2099
agaacctcccagcttccggaatagaggagcggggcagaaatatcctgctttttatttcagagctgacgtttgcaatcctagtgcactagcggaaaaaaaaaaaaaaaaaaaaaaaaaaaaaagctgaattttccgcgctctcctggcaaattggcgtccgctctccgacgctaaaccaaaggaaaaggagtgttcaatggcgacagggcgctctttgaagccggctcctcacgcggattctggcccaggccgccgctccggtcccagtccggctgcagagcgaattggagaggatggcacctcctgcttcccggggggcggaaggagcgccagcgcctaaggtgggtcacctgccaggaagggaatacgcatggtgcagactcacgtgggaggagcacaggtcccgggtacaagtgccgagctggcgacttagagaagaggtagactcgggctcagaccaagcaggcgtaagggagtagacgggacgtcccgtgtttgcagtgacggcggagtcacccatcccagcagcctcaccttcttggagcgctggtccctccccttggactgaaaccccaggggccaccgcaccgggtgggcgggaccgactactacccgaccagccgctggagctgcgtgccaggcggggctgtgcggagcagctgagcgcagagcggagcaccaggcacctagcgggccggactctgggcggcacccgagcgggccgggcagcagtgggcgctcgcgatcctcctctgcccaacgcgctctccctccgggcccggcctcctccgtcccctccttttgctcccgctcctcctcccgctcctccccctcctcgggattgagcaccaaaacgcccgcctgcaaggtcctctgcgccctggcagccaggagtcgccgccacgacagccgggtctcagtgggtgcctgcgccttctccccgcccgcctgccccgggccatccagaaacttgctctacccgccgcgggtgctcggcagtgctgcccatggcccagcctaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttcagaatgatcttggacctggatactttgccccaggtggcagctggcctccagaaagccaattagaatagaaaagagaaactgcgaaatctatgcgtgtcttcatcctgtcggttctgtgaaaggctgactaaaagggtagtagtcttttgcttagtctgaaagtctgcttacttcctgaaagacacattggcattatagacatatattccatatgcactgagacataaatatgtgtatgtttcaaaatcaactctaaatttggagtcctgaatgtgaaagaaaaagtaagttcccaagtgttgaagttaaaaagagaaaagggcagagttgaaggtagcacctaagagaaccactgtacctgcccccagaggagtggctggagttcagttttacttctgcccctgagcagccagcttgttggagatggtcacataaacccttcttatcctcagttttttcatgcattcttcatgcagtcagccttttacagaattaaacccattggattttaataaaaataaaacattcattacagtaaaagagaaaatacaaacaagcaaaataaaccggcttcctgacatggtttataccgcaggaaaatgacagaaatggacgttattaatcatctcctacacttaagaactcattgaaatttctccaagcaaccccaggatgcagatattattatggaaatttcaaagaggaggaattaggcccagagaacatgagaaacttgcccaaggtcacattgactataaactcaggcttagaggctactcagagccaaagcacaggttatttatgtatttagtttttacccaactctttctgaactcaaaaggaaaagcccagactcagagccagttcttcctgacctgacttaacatttcttcccaggtgccaaatatcttccatcctaagaggtgtgtcccagatacaggaagggcaagaagaagcctgcatttttctcagcagtgttatcagggaagtgagtcaccttggtacgtttcagcagctccagcctgacctgaccttagcatggcctatgccccaccccatatcatgaacagagagcagagaggatgccttcctctttagaatccattgaagttgtcattaagccatcatctcccccagaggaagtagcagaaatatttacagcaggcccctggtggacatggtacttttcaataggcagagagcctccctctgcagcacatcgttggatcttgcttttaccatactccttgaagagctgaagaaataagagggcccagcaaggttaagtcaagtttccaagcctgttcaggaatatggtgactgaaaggaaactgcaatgagagtctctgactgaagaagatgctctttgcaaactgcctgtaaattcctgtcccctgacagggatggtctggtagaagcatgaactgtggatgcaagaggcagcggggaggagtggaggaagacaggaccagcacatggaatataatctagctgctgggactggcatagtcgatggaggcggtggtccagtgtaaaatgatcagtgaatgtaaattcaatatgttttcatttgggggtgcagagtcgtggctaaaggaatgttcaaatgagtctaccatgagcaagggatcagaggtcctagtggcactatctgttcattcatttttggtacaaccccagccagtcattgagaaggtacactgtgtaagaaaccatcactccagacttacccaaggtatttattgctagatctcaccaagcactgtcaaattcaaaggaggccctgtagtagaccctgggctgtccttacagggccaaaatgcagtgactcaggagcctaatagcacccggtccctccaaaacatgccttctaccaattccattaacagagacaggtgtcagtggaaggggtgggtctcctgtccagaccaccccggcccgggagcagcctgggggatctaggtgggtccttccagagaggcaagtgagaacaactgaaccaagcctcagctattagatttggaatattcacacacttgacactccagagtcagaacagccccttccctttcccttcctcctggaatcagatagggttgaaatccttttaacaccatttggttatcagctcacaacctgaaggtttgcaagtttaggaaaagtgacatgcctctgagcacagggtgctttactccttctgtgcttggaggcttacccaactgaaaggagatggagggcaggagaggccgatgcctagcgtgcctgctgcttacaggggtggtgtcacaggtcaccattattcattaaaattttacttttttgatcccctaccacatgctcaacatggtattgagtcctcaagaatataaaaagaaaatacaacaggaaccagtagtcattaactgtttgttctggactttaataaaagtacagagggtcttggagtacaaaggcaaagacatttagctgtgtatagaatgggtgggggaatgtgttccatggtttggcattcagttcagcaacattcctgagagaaatcaactagcccccttatagagaagaggaaactgagatttaaaaagtggtcctggccgggtgtagtggctcacgcctgtaatcccagcactttgggaggccaagacaggtgaatcacgaggtcaggagttcaagaccagcctgaccaacatggtgaaaccccatctctactaaaaatacaaaaatgtgccaggcatggtggcgagtgcctgtaatcccagctactcaggacactgaggcaagagaaccacttgaacctggcaggtggaggttgcagggggccgagatgatgccactgcactccagcctgggcaacagagcaagactccatctcaaaaaaaaaaaaaaaaaaaaaagataaattaataataaaaaaataaaaaagtaatcctgacttcaagtcatttttttcagaagaaaggattcttgctcactccagggaaatagtccagaaatggaaaatgttgacatcacaaatcacaaaagaaggtgaaaaatatcagagaccctctccagaatgtcatttctcagaaatattaagaaatagagaatcttcccagaggtcgcatgtcagggcaggtcacttaacttgtgggccacagagaccctgaccttcctgtgggaaggcttcatggaggaattgccataaagctggggcacgcacgaatggcagtagtgtcaccagagcagggcattctgaacaagggaagcttgagacatgaagacagtggtcacggggagaggctgggggtagagggtagaggtaggcaagagatttgtctgagtggcatgtcaaatgtgttaaactcaatgagaagctactgctttccaaggctggagtgttggaagcttacttagcaggcacccatgtgaatttggctcctgtgcaggtgtatctgttgcataaaaatagctatcatttgttgcacacctgccatgtgcttggtattttaaatatattgcttctaacctatataacaaccctaggaagtagaaaatgggctactaattttacagaaaaataaactcagaaattaaagggcttgcccatgttgatagagccattacttcttacaaatgaaattttgtctccgatgtctctgctccttttcagtccatctatttgtgggtaagtggaggaagatataaagcatatgcatctgtctattaggcagagcctgtaagggaaattatgggcatctaggatttggagttggacagttagggtgatatcaagattaccttcaagcaaagcagtggctgggatttgatgcaacagggacgtgataaaacatgctcctaaccggcagcagctcatttcggaagactgagcctgagttaaaggccagagcaacataacagagttctccaaacagcacacagtgagagaaggccaaagctaaagaggacatcatcggatttagctgcttcactaaagtgttttgatgtagaaaatgaccttggtgctttagttatccctgatgtcaagacctttactctattttgcccaaatttctcagttagataacagcaaagagagagagccagaagacctgggtgtgcatcctagctgtaccaatcactgaccatgggatcttagattcagactctgagaacctccatttccttctccataaaaatgggcagatatgtactgtactctgttgggggaaaactccaactcaatgagataaagtaggtaaaaactataaacccagtgcatatgttacttagtggttaaaaacatttgggactttaggagacagaccaaaactggttttgaaccagtcggcagaaatgcgctgccttttttcctcctctgcttcccagctatgtgactgtagctattgctgttaatgctccatccagagctcatttaccagggaagtgctctcaaccccagctgccacaaagattgtcttctgtactattttctgaaggatttctcttagttggcaggagttttcttacctgaagatgcctgagaaatgttgtccaccccactcccctgctttcctagggttagggcatgactaatgattgactgacccatgtgggatggggcatgggggtagtagggtaacagtccaccctcattgcctccaggcaggacaacctctggtgcaactcatgctcagagctcctcgtgagatcaggctgaggctagacttctcctgaaactgtacttttacttatttcttccgaaacttcatccttttcccacattaccttactcatttcttctgctaccctattctcagtaaatgtgtttcccaagaaaacaggaatcccccctcagactttgcttctagaccatccactctaaagtcttaaccttgcatgcatgttttcttctctctgtattttacatgtataacgtgatcaacccacggagttattagaattcttccaattaaatgagatatagcagagaatgagtctattttattggctagcaaatagcaaagtgttaaattcaataatggctgaaattgttaccaagtagtaggctcttttattagcttatcggactaccaaaatagtataatgcatcaatatcaaacttaaatttcaacttcataaaacaattctgggcccaacaaatatgaaggtattgctccatcttatgtagcaacatcttgtatttctattgtttgataaatattccacttagaactaa

SEQ ID NO: 140196 - DNA, 496 bp, Homo sapiens
  Payload ID: 7497
  Gene Symbol: HS3ST1
  Gene Name: heparan sulfate (glucosamine) 3-O-sulfotransferase 1
  ENST ID: ENST00000510712
  CDS Start-End: 249-496
gacagggcgctctttgaagccggctcctcacgcggattctggcccaggccgccgctccggtcccagtccggctgcagagcgaattggagaggatggcacctcctgcttcccggggggcggaaggagcgccagcgcctaagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 140197 - DNA, 491 bp, Homo sapiens
  Payload ID: 7497
  Gene Symbol: HS3ST1
  Gene Name: heparan sulfate (glucosamine) 3-O-sulfotransferase 1
  ENST ID: ENST00000514690
  CDS Start-End: 244-491
ctaagaagaatcgaggctggagcaggtggagtggatgcagagggaaccaggaagcaaaggctggggattttcccatcctcctcacctcctgccctagcacctctgctctggaagtcccgagggaccggttgatcttaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgc

SEQ ID NO: 140198 - DNA, 2314 bp, Homo sapiens
  Payload ID: 7498
  Gene Symbol: HS3ST2
  Gene Name: heparan sulfate (glucosamine) 3-O-sulfotransferase 2
  Uniprot ID: Q9Y278
  ENST ID: ENST00000261374
  CDS Start-End: 435-1538
gccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaa

SEQ ID NO: 140199 - DNA, 2266 bp, Homo sapiens
  Payload ID: 7498
  Gene Symbol: HS3ST2
  Gene Name: heparan sulfate (glucosamine) 3-O-sulfotransferase 2
  ENST ID: ENST00000473392
  CDS Start-End: 115-603
cccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggtgactcagacactacctgtgtggttgtcggtgcacacacttgggtgattgtgctgaagctacctggactggagacaagaatgtgtgtcttgctaaactgtggatgataattaaattcatggaagcagcagcaatgacccaggagcacgtatagctggagaagaaggtcagagggtctcactctgtcattcaagcttgggtgcagtggaatgatcatagctcacttcaacctcaaactcctgggctcaagcggtcctcccacctcagcttcccaaggagctgacactacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatat

SEQ ID NO: 140200 - DNA, 2527 bp, Homo sapiens
  Payload ID: 7499
  Gene Symbol: HS3ST3A1
  Gene Name: heparan sulfate (glucosamine) 3-O-sulfotransferase 3A1
  Uniprot ID: Q9Y663
  ENST ID: ENST00000284110
  CDS Start-End: 799-2019
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggctgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcacggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgctccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttg

SEQ ID NO: 140201 - DNA, 750 bp, Homo sapiens
  Payload ID: 7499
  Gene Symbol: HS3ST3A1
  Gene Name: heparan sulfate (glucosamine) 3-O-sulfotransferase 3A1
  ENST ID: ENST00000578576
  CDS Start-End: 109-723
cagtactgaagaagggcttcccagatttttcttcttcttaggtcattttgcataagattgggagaaagacaagagaaggaggaaatctaacgaaaccaaagggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaa

SEQ ID NO: 140202 - DNA, 5367 bp, Homo sapiens
  Payload ID: 7500
  Gene Symbol: HS3ST3B1
  Gene Name: heparan sulfate (glucosamine) 3-O-sulfotransferase 3B1
  Uniprot ID: Q9Y662
  ENST ID: ENST00000360954
  CDS Start-End: 437-1609
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccctgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgtacagaaatctattttataataatttatttttaattcataagcaattaattcactaagctgcctagccacactctttagagagttagcttcataatctgttaacattccaaagtgtttaactctagtatttcgttctcttcttcacaattgatggtgcttctattttttcttctcccctacctgttatatttaaaacaaagaaaagcacaacttgagatttttgttgttacgggtattcagccttcagtcaccgtctgagttctccagttgctgcctccttgtcttgtcttgggtctcccattccagcttccctgtctcttcctgcctgtgtacctcgtaggaacgctgagctgcctcaacagggctgtattctgaagggcaggcctcatgcagcagcctccttgcagatgtggtgtcccgtccaatgatgtagcctgaaagccacagccctagggttctgtccctccctccattcagcacatggggaaatttctcactccctttacagggacatccacatcctttttttttcttttttttttttttttttttttgagatggagtcttgctcttgttgcccaggctggggcgtaatggtgtgatatatgcttaccacaacctctggctcccggttcaagcgattctcctgtctcagcctcccaagtatctgggattacaggcatgcaccaccatgcctggctaattttgtatttttagtagagacggggtttcttcatgttggtcaggctggtatcaaactcccgacctcaggtgatccgcctgccttggcctccaaagtgttgggattataggcgtgagccactgcgcccgctatccacatccttctagagtcagaatggtagggtctgttgacttcagcttttgattttgcaggatggccctgtgtcctcctctgccccattccctggttcattaaccagtttgaagtgtatgtagattgttgccccgtctttcccaggtcacatgtgtgagatgcctgggtgctgcttcagaaatcaagatgatctcctttaatttgcatgaaactacaccatgctgcgttccccaggcagacagttctgctttgacacaccaaagaatcccgtaggctagcagagccaccagcacaaaccaagggcgctgggtgtcgagactcagaggggtcagctgtgtccctcggcatcagcgtctaccaaggtgctgctaggtacagagccagccagtgttgggcagcaggctcacagcctcaatagggagaaaagacaaaggcctcaaaatgacaggcagcctgacagaggaaggagtctgacacctcagcttgatgcgtctttggaattcctagctcatctcagaattatatcttagagtgataatatgggtggtagccagtggccaaacagcaagaactaagagtggcccttgcaaaaaaaggttgggaaagctgggcccatattgcctgtaaacccttgagcctgatgctcatacagctgtcccttgttttagccaggtcttgacagaagggttaccagcactgtcactgctctacagaatgctctccccgtgcctctctgttgatttataacagttgggtaaccagatagcaatatagtggcaattgagtagccatatagtaatacaggggcagttggttaaacatatagcaatatcacataatgatatgtttaatttaacctcagttttttaaaccagaatgcttctaccataaaagaattgtgatttcagttatacttccatcaaggaatatgtgggaagatatacatattgtcaaaatggttgggatgggatagttacaaaggacacttttgtatgttgtatgggatcacttgcctgatagtataaggaacattgtatgaaaagatgaaaagatacttcatttttagaaactgatcagagatgtcactggtctttaagtgatgtcttgaaaatccagtatgtatttgcccaaaagttttagcctacatctagctagcttacacttagcagccaaaccatcattgtgtaggttctgttttggaggaagctcatgggggatctgtgtatttcttaggtttctccctgttctccaatgttttatccatttcgtagcttttttactgtctccagaaagtagtgtgggacctgcacttaggggaataccagaatcatagcgtggttctgccttcttgatgagtgattgtgaaaaacacctgcataagggtgctaattggttgtgtattttttcatttatttgaaatcaaactgagaacacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttagatgttttctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaa

SEQ ID NO: 140203 - DNA, 2808 bp, Homo sapiens
  Payload ID: 7500
  Gene Symbol: HS3ST3B1
  Gene Name: heparan sulfate (glucosamine) 3-O-sulfotransferase 3B1
  Uniprot ID: Q9Y662
  ENST ID: ENST00000466596
  CDS Start-End: 437-1609
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccctgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttag

SEQ ID NO: 140204 - DNA, 3203 bp, Homo sapiens
  Payload ID: 7501
  Gene Symbol: HS3ST4
  Gene Name: heparan sulfate (glucosamine) 3-O-sulfotransferase 4
  Uniprot ID: Q9Y661
  ENST ID: ENST00000331351
  CDS Start-End: 393-1763
cagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctgatta

SEQ ID NO: 140205 - DNA, 3901 bp, Homo sapiens
  Payload ID: 7502
  Gene Symbol: HS3ST5
  Gene Name: heparan sulfate (glucosamine) 3-O-sulfotransferase 5
  Uniprot ID: Q8IZT8
  ENST ID: ENST00000312719
  CDS Start-End: 1190-2230
gggagggtgtggactggcagccactctgcagctggtcgccagggacccggtccctcctgcgcgcccaagtgatggaggggaagagattcgcttagacacacacacgcgcacacagctgggcacgtctccgggaggcagctgccggctcgggcgctctgggggccgggcggcggccgtgacagcgccagccgcggggagcggggcgcccgcacagcttggcaccggaggctcgaggacgcaggaagggaagatcccagtcacactgagtgttgctcttttgggcggattgggagggagcgggctgcccgaggagctgtcaccgaggacgcccgaagtctcgccctctgcgcgcagggtccggggctgcgccggtgccctcgtggggcaaggaggatgcgcacctccccccgcagagcggctgcggtctccggcactgcgcggactccggctcctgcggccgcccgtgccgtgcccgcgccacgggagcgcgccctgccgcacctggttccagcctctcggggaagtgcaggaaacgcgccctaaactccactacttctcgcccgcctgcccccccgcccggctccccgcctcagacctcgccgccgccgccgccgccgccgccgcctgcgtgtggggcccgctcgcgtcttactcacacgcgccacgcacagccctgttggtttgctctcattcacgccgactcgctctccgccgagcctagcccgggcatccgaaactactggaccaactgccgtccggaccgcagcagcggccgggtgacccccacgcgacccgccgccgacccccgcgccctgaggctcccgcccgcgccgccaccgccggggaccacgagataatcagatactcactgtcttcagcattggtgtcttctattctcaacggcatttctggtggccaccccaggagtctccctgacctgttttaaaacccttggaaattaaggagagaatccactacatatattcctttgaaagtttccaccatatatgttcaaaaattgctgaatgagcacaaggatttgaaggtgctaaagcaagggataaaccaaaaggacagccagtaggtgaggagaggccatggaatacccgccaacaagataatcatcgctggaataatagggacctgtctgaatgtaggctgcagcagtcctgaaggttgatggagggccatgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcattttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtaccccagtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcagctgcctagtgttgccattactaacataaacatatggctcatatttccatccagagaaattaatgctaaattggtgcctcgctaacatcagatacactgtattatgcttaaatatattcagtaaaatgtggaaaggggtattaacaacgacaacaaaaagatggattttttttttctcacaatcacagttgctaatccagtgggagatgtttgagagagttttgttcaacatcacagtgagagtgcctagggaaatcagaaaattacaatggattcccctttgattgtaataagtgttgattttctccatgagttgtttatcctgtctagtgatttgatggtgaacttttctaaataaatagccctttcccctccggtgtcggta

SEQ ID NO: 140206 - DNA, 2744 bp, Homo sapiens
  Payload ID: 7502
  Gene Symbol: HS3ST5
  Gene Name: heparan sulfate (glucosamine) 3-O-sulfotransferase 5
  Uniprot ID: Q8IZT8
  ENST ID: ENST00000411826
  CDS Start-End: 33-1073
gctgcagcagtcctgaaggttgatggagggccatgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcattttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtaccccagtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcagctgcctagtgttgccattactaacataaacatatggctcatatttccatccagagaaattaatgctaaattggtgcctcgctaacatcagatacactgtattatgcttaaatatattcagtaaaatgtggaaaggggtattaacaacgacaacaaaaagatggattttttttttctcacaatcacagttgctaatccagtgggagatgtttgagagagttttgttcaacatcacagtgagagtgcctagggaaatcagaaaattacaatggattcccctttgattgtaataagtgttgattttctccatgagttgtttatcctgtctagtgatttgatggtgaacttttctaaataaatagccctttcccctccggtgtcggta

SEQ ID NO: 140207 - DNA, 1273 bp, Homo sapiens
  Payload ID: 7503
  Gene Symbol: HS3ST6
  Gene Name: heparan sulfate (glucosamine) 3-O-sulfotransferase 6
  Uniprot ID: Q96QI5
  ENST ID: ENST00000293937
  CDS Start-End: 118-1146
gctgcgggaccgccgggcgcagagcacaagccgggcacccacggactgagcggcgcgcgggccgagatgcgcgcccgcctgctgcccccgctcccgggcctggagcggcgcgaccccatggcaggtagcggcggcctgggcggcggggccgggggcggccagggcgcaggggccgggcaaggggccgctctgcgggcgtcccgcgcgccgatgctgctcgtggccctggtgctcggcgcctactgcctctgcgccctccccggccgctgcccgccggccgcccgcgcccccgcgccggcccccgcgccctccgagccgtccagctccgtccaccgcccgggagcacccggcctgcctttggccagcggtcccggccgccggcgcttcccgcaagcgctcatcgttggcgtgaagaagggcggcacgcgcgccctgctggagtttctgcggctgcaccccgacgtccgcgcgctgggctctgagccccacttcttcgacaggtgctacgagcgcggcctcgcctggtaccggagtctgatgccccgaaccctggatgggcagatcaccatggagaagacccccagctacttcgtgacgcgagaggccccccgccgcatccacgccatgtccccggacacgaagctgatcgtggtggtgcggaaccccgtgacccgggccatctccgactacgcccagacgctctccaagaccccgggcctgcccagcttccgcgccctggccttccgccacggcctgggccccgtggacacagcctggagcgccgtccgcatcggcctgtacgcccagcacctggaccactggctgcgctacttccccctgtcccacttcctgttcgtcagcggggagcgtctggtcagcgacccggccggagaggtcggccgcgtgcaggacttcctgggcctgaaacgggtcgtcacggacaagcacttctacttcaacgccaccaagggcttcccctgcctcaagaaggcccagggcggcagccgtccccgctgcctgggcaagtccaagggccggccacacccacgcgtgccccaggccctggtccggcgcctgcaggagttctaccggcccttcaaccgcaggttctaccagatgacgggccaggacttcggctggggctgagcggcaccctggggatgctcagcaccttgattgacacccgctcgcctggccagagcgggctgcgtgcacatgctgggcagagaggaatatttaagaaataaagcttggacccagatttttccacaaa

SEQ ID NO: 140208 - DNA, 1273 bp, Homo sapiens; identical to SEQ ID NO: 140207
  Payload ID: 7503
  Gene Symbol: HS3ST6
  Gene Name: heparan sulfate (glucosamine) 3-O-sulfotransferase 6
  Uniprot ID: Q96QI5
  ENST ID: ENST00000454677
  CDS Start-End: 118-1146

SEQ ID NO: 140209 - DNA, 6736 bp, Homo sapiens
  Payload ID: 7504
  Gene Symbol: HS2ST1
  Gene Name: heparan sulfate 2-O-sulfotransferase 1
  Uniprot ID: Q7LGA3
  ENST ID: ENST00000370550
  CDS Start-End: 364-1434
aaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatatttggaaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattggattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggccaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatctgtgtaaatcatctaactggatttttccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactactctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 140210 - DNA, 1585 bp, Homo sapiens
  Payload ID: 7504
  Gene Symbol: HS2ST1
  Gene Name: heparan sulfate 2-O-sulfotransferase 1
  Uniprot ID: Q7LGA3
  ENST ID: ENST00000370551
  CDS Start-End: 390-1079
cggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggtaggggagataaagttggctcagattgattatcatccttattatctctgtaatctgtgtttcatttcacaagggctagatatagggaaatcggtgaaagactagactaaaaataacatgtaattcagtaatatctagttttgcagttacttttaaatgcatttaaaagattcctcatgtagagtgatatcctaatatccttgcattgttttctgagatgccggtttttagtatttcttatttttggtgttatgttttgctgtattccagcagagctcttagagactgggggtgggggtgggtgtcataaatcttattttgtccaaagcttactgttttagctattcatgttaaattaagaaaaggcttagtgggttaaaattcacctggttttactgttaaactgattttgactttaagagaagccaaggttatggctgtggtttagtttgctagtaaatatcaagtggaaaataaagatactttaataagaactgtatttcctcagaa

SEQ ID NO: 140211 - DNA, 540 bp, Homo sapiens
  Payload ID: 7504
  Gene Symbol: HS2ST1
  Gene Name: heparan sulfate 2-O-sulfotransferase 1
  ENST ID: ENST00000591456
  CDS Start-End: 208-540
ctatggctgtagaaaaataacagtactgctcccatgaaaatctgattttcagcagtgtgaacctgcccagaaggaactgatggtgagaggttgaggaggaagaggaggagttggtcttgctgtctcaggagtggcaaaggtggaagaaaattcttgtaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagagg

SEQ ID NO: 140212 - DNA, 3932 bp, Homo sapiens
  Payload ID: 7505
  Gene Symbol: HS6ST1
  Gene Name: heparan sulfate 6-O-sulfotransferase 1
  Uniprot ID: O60243
  ENST ID: ENST00000259241
  CDS Start-End: 15-1250
ggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacacccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaagga

SEQ ID NO: 140213 - DNA, 1938 bp, Homo sapiens
  Payload ID: 7506
  Gene Symbol: HS6ST2
  Gene Name: heparan sulfate 6-O-sulfotransferase 2
  Uniprot ID: Q96MM7
  ENST ID: ENST00000370833
  CDS Start-End: 1-1938
atggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaa

SEQ ID NO: 140214 - DNA, 4441 bp, Homo sapiens
  Payload ID: 7506
  Gene Symbol: HS6ST2
  Gene Name: heparan sulfate 6-O-sulfotransferase 2
  Uniprot ID: Q96MM7
  ENST ID: ENST00000370836
  CDS Start-End: 417-2234
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattac

SEQ ID NO: 140215 - DNA, 1818 bp, Homo sapiens
  Payload ID: 7506
  Gene Symbol: HS6ST2
  Gene Name: heparan sulfate 6-O-sulfotransferase 2
  Uniprot ID: Q96MM7
  ENST ID: ENST00000406696
  CDS Start-End: 1-1818
atggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaa

SEQ ID NO: 140216 - DNA, 2607 bp, Homo sapiens
  Payload ID: 7506
  Gene Symbol: HS6ST2
  Gene Name: heparan sulfate 6-O-sulfotransferase 2
  Uniprot ID: Q96MM7
  ENST ID: ENST00000521489
  CDS Start-End: 417-2354
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagact

SEQ ID NO: 140217 - DNA, 7804 bp, Homo sapiens
  Payload ID: 7507
  Gene Symbol: HS6ST3
  Gene Name: heparan sulfate 6-O-sulfotransferase 3
  Uniprot ID: Q8IZP7
  ENST ID: ENST00000376705
  CDS Start-End: 25-1440
gcctgccggcctgagagcgggaccatggatgaaaggttcaacaagtggctgctgacgccggtgctcactctcctcttcgtggtcatcatgtaccagtacgtgtccccctcctgcaccagctcctgcaccaacttcggggagcagccccgcgcgggggaggccggcccgcccgccgtcccgggtcccgcccgccgggctcaggcgccgccggaggagtgggagcggcggccccagttgcccccgccgccccgggggccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggaatttctattacatcacaatgttacgggatccagtgtcacgttacctgagcgagtggaaacatgtccagagaggggccacttggaaaacctctcttcatatgtgtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgcagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtagggtaggagtgcatcccatataggccattttagaaggccaaggagagccacaccgaaaaaggagacagttcctgtgatctcctttgcaggagcatagaatagtttgggtaccaggaacccacagaggcacacatgaaaagccaaattatggcttggatgttctgctgaaactggtctatgtcatactgtctcctgttatgagaatatcagttggtataaagagagagaaagagaaaaacatttcagcccttagatgaggtcttacaccaacccccacttggctgttggctgtcatcttgaactctatttgaatgtgacttaaatcacaagtaacgtgttttgttgttgcagttgttttgaaacaaaattatcctattattgaccattgctagagacccacatcctacaaaatcctgacaccataaccttaagccatgcctttccttccatcttttagggaacggggagtggatccaggacaggggaggttgtaacccctgagaaatgaacattggtaggagcatttaagagaaaacttgcttatttgctaatgcctaaaggggtctcactttaccaattgttactttcaatgtgaggaatgaatgataaattaagagaaaaaaatatcaggaaggtcaatatatgcctaacatttctaaactggccacataaccttagatttttaaaggaatatttcagagtttaatctttttggagaagttatgttctttaatcgggtactaccagtcttgaaattttgccaccacagaaagaaagatgtttttaaaagcttggcccaaagaataggaacttagctagcatgtatacaaaatatatttgaggttactaaatgaataaaaactcggaattaggccaggagacatggaataccattcatgggatggttatcacaggagtttagaaagactctgcctcccagcatcttgaatatctccagcctgttcactgttttcttcctacatgatctttacctgttgttagactgtggccacagccagtaaatcaggccagagtgtctcaaactggacaagaaatgtgctgcattgccgagttcttattttcaccttttcataatcccaactacaataacaagaattttattgactaataagggaatatgtatggaagaaggaagagaaagcctttgtctagcatttattaggaggatcagagtgagtgggaagtttcacaacggattgatctgatcaatcccttcaaggagctgaaggcaaaatgtgtaaaacccctaaatcagattgaaaagcctatttcattgatatccaacatgtttgatgtttaagctagctttacctaagccacttctcagcctccagaatactctctctggggttgtgagtcagtcagcccacaagcattcacagagtgcttacctgccccgagggaagtccagcagctccaccagatagagatctggagatgcttctctcactgtgcttggcttcatctggggtgcaagggaaggcattatcgggtggctcccttgctccaggaactgaacgaggcccttttcataccttaaatatattctgcacaacaaatgggtattgttagtctccatttcatagatgaaaatagtgaagcccacagaaaataagtagctcctccacaggttgtaagctaggtctagctgactgcaaaggtcaagttctctttactccgtcaccatatccatatggaataagggctcgtcctacctaaagcttcctgccaataatgcaagaagccagctgcaatttcccagaagcatttgtctctaacccatgtgggtagcccgaccatgacagcaccacgctaacagtgacccagagccatactgccttgggtcagtccagccccctccacatcactgagccatcaatgagctgagagatcaatgactttttaggcagctgtgttttttaagccatatacaagagtaagttaaaaggggccaagtaaatgttgcttgttatttggtagagattaggctcacaaaatatttctccatttccagtgatttgttcctaaggtagaagggaaggaggattgcagctgggattaatgttcgtctctctctctctctctctctagcttctcatctcattgttaggatctaatgttctgcctagaatagcaggactgcaaattatccttctgcctgcccctgtgacacacacacacacacacacacacacacacaaacaatccagtgttttgtcatgtggaaaatcaaaacaagttagaaagcattcagattgtttcttttaaactcactttaaaattttggcaaggaattcatgcataactgagacttggaggcagcccctgctcacttcacgctgttccttaggcacctcgggattggtatcaaaggcttccactgccttctgctgaaggcatgatgtatgcggctccacttgagaccaggtatcaggatgttcagagggagccagctctttatgttggccccaggccagtactaagcaaattaaaaagaccgacatgggcttcctccctcatatcatttcattctaaagcagcaagcttgtcatacccatggggtcctatgttgatagaaatggagaggtagggatacagtttattctccaaaaatggactgcccacttccatgctgagtgatgctcagggaagtgatgcccgcagaaggcgtctgggcctaaggatccatggaagtcaggagcattaaatcccaaaccaaatcaactccagatatatcagtgtcaaaagcccaagaaaagacaaaaaagaaaaaaacaatccccaggggttctatgaccctattgactcctacagttctttcccttctcttggcaatggaagctccagtacccagattggagattaggatgagacaactttgtgtatatgtgcacgtgtgtggtgtgtgtgtgttttattaaggactaagatacacacttatctattctgtctccttctagcttttaggcagcctactcttggaaactggaggaaactgccctgagaattattagaatgctaataatagtaattggtaacattaacaatcagtgttagacaacagtgaggcatatcatgtgtttttattaaaaatgataaagatgtgtttcttctcatctaaaggaggtaactttgtgataattagtttgattaaaagtttgaagtatgaggactccttgttatgcctttaaggtaatttttaaaaaaaatctgagtagagatagtactaatattggcaagaaggtccccaggatagacctagcaaggagataagaatagatcattaaaaaataaatataaatggattggatagaattcccattcagctgttttaacacagaaattcaaaatagtgacttaacatggaagctatttctctcttacttaaaggcaaactggttttacagctctggtgtgtgatgttaccagacgcctaggccctctcctgttgctctgtcatcctaatgtgctgcatccacctcatggaccaagatggctgccacagctcctgccatcacatttacatttaagatagtagagaggaagtggagggaagttgcacatattgcttccagtcacatctcatgggttaaaacctagacatttgccacatctagctgcaaagaaggctagggaatgtctttattattgattgtcatgtgccttgataagcataggaggttctgttattaaagaaacaatgtgaaataatgtggaaattaatactgataaagactatcagtatctgatacaaaagggaaccaaacgatatttaagtgctttttaatgtcacttacttcatcatatgttttgcgaaagataagactaaaattcatcactttgtgtagcatttaatggttttcagaacatttttgcatgtgctgtctcatttggtcctcattacattcttgtgtgctaaataggacctctattcattacaccacttgctagtttgggatggagagtcagatatgttgaaagatttcccaacgactctaatttatgagcaagaaagttgcttagagccccagccttttgacttcatagtctttccgactactttatgcagctcagcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaatgcacatgaacccatcttcacagcatgtgaaagaaccaacctgcctggcagaggtgcagaaatttccagaggactggcctagctataaacaccagcaacatctgcaacacaaaagcccttgaacttctaggcaaggactcatgctaacctagcagtactccagattgagaacgcagatggacaggtgtctcttgagcctgtgttccaagatgtctgtggaaaggattgcaactgtcatcctttggcacactcagtggaacctgtgtgagctacatgttctgctgcattatgggaactcatcaaagggccagattgacatcttgccagaaaaaccagtgttttgaggagcaaaagttttgtgtacttcagtaattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaagagcaa

SEQ ID NO: 140218 - DNA, 7073 bp, Homo sapiens
  Payload ID: 7507
  Gene Symbol: HS6ST3
  Gene Name: heparan sulfate 6-O-sulfotransferase 3
  ENST ID: ENST00000620595
  CDS Start-End: 1-711
aggaatttctattacatcacaatgttacgggatccagtgtcacgttacctgagcgagtggaaacatgtccagagaggggccacttggaaaacctctcttcatatgtgtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgcagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtagggtaggagtgcatcccatataggccattttagaaggccaaggagagccacaccgaaaaaggagacagttcctgtgatctcctttgcaggagcatagaatagtttgggtaccaggaacccacagaggcacacatgaaaagccaaattatggcttggatgttctgctgaaactggtctatgtcatactgtctcctgttatgagaatatcagttggtataaagagagagaaagagaaaaacatttcagcccttagatgaggtcttacaccaacccccacttggctgttggctgtcatcttgaactctatttgaatgtgacttaaatcacaagtaacgtgttttgttgttgcagttgttttgaaacaaaattatcctattattgaccattgctagagacccacatcctacaaaatcctgacaccataaccttaagccatgcctttccttccatcttttagggaacggggagtggatccaggacaggggaggttgtaacccctgagaaatgaacattggtaggagcatttaagagaaaacttgcttatttgctaatgcctaaaggggtctcactttaccaattgttactttcaatgtgaggaatgaatgataaattaagagaaaaaaatatcaggaaggtcaatatatgcctaacatttctaaactggccacataaccttagatttttaaaggaatatttcagagtttaatctttttggagaagttatgttctttaatcgggtactaccagtcttgaaattttgccaccacagaaagaaagatgtttttaaaagcttggcccaaagaataggaacttagctagcatgtatacaaaatatatttgaggttactaaatgaataaaaactcggaattaggccaggagacatggaataccattcatgggatggttatcacaggagtttagaaagactctgcctcccagcatcttgaatatctccagcctgttcactgttttcttcctacatgatctttacctgttgttagactgtggccacagccagtaaatcaggccagagtgtctcaaactggacaagaaatgtgctgcattgccgagttcttattttcaccttttcataatcccaactacaataacaagaattttattgactaataagggaatatgtatggaagaaggaagagaaagcctttgtctagcatttattaggaggatcagagtgagtgggaagtttcacaacggattgatctgatcaatcccttcaaggagctgaaggcaaaatgtgtaaaacccctaaatcagattgaaaagcctatttcattgatatccaacatgtttgatgtttaagctagctttacctaagccacttctcagcctccagaatactctctctggggttgtgagtcagtcagcccacaagcattcacagagtgcttacctgccccgagggaagtccagcagctccaccagatagagatctggagatgcttctctcactgtgcttggcttcatctggggtgcaagggaaggcattatcgggtggctcccttgctccaggaactgaacgaggcccttttcataccttaaatatattctgcacaacaaatgggtattgttagtctccatttcatagatgaaaatagtgaagcccacagaaaataagtagctcctccacaggttgtaagctaggtctagctgactgcaaaggtcaagttctctttactccgtcaccatatccatatggaataagggctcgtcctacctaaagcttcctgccaataatgcaagaagccagctgcaatttcccagaagcatttgtctctaacccatgtgggtagcccgaccatgacagcaccacgctaacagtgacccagagccatactgccttgggtcagtccagccccctccacatcactgagccatcaatgagctgagagatcaatgactttttaggcagctgtgttttttaagccatatacaagagtaagttaaaaggggccaagtaaatgttgcttgttatttggtagagattaggctcacaaaatatttctccatttccagtgatttgttcctaaggtagaagggaaggaggattgcagctgggattaatgttcgtctctctctctctctctctctagcttctcatctcattgttaggatctaatgttctgcctagaatagcaggactgcaaattatccttctgcctgcccctgtgacacacacacacacacacacacacacacacaaacaatccagtgttttgtcatgtggaaaatcaaaacaagttagaaagcattcagattgtttcttttaaactcactttaaaattttggcaaggaattcatgcataactgagacttggaggcagcccctgctcacttcacgctgttccttaggcacctcgggattggtatcaaaggcttccactgccttctgctgaaggcatgatgtatgcggctccacttgagaccaggtatcaggatgttcagagggagccagctctttatgttggccccaggccagtactaagcaaattaaaaagaccgacatgggcttcctccctcatatcatttcattctaaagcagcaagcttgtcatacccatggggtcctatgttgatagaaatggagaggtagggatacagtttattctccaaaaatggactgcccacttccatgctgagtgatgctcagggaagtgatgcccgcagaaggcgtctgggcctaaggatccatggaagtcaggagcattaaatcccaaaccaaatcaactccagatatatcagtgtcaaaagcccaagaaaagacaaaaaagaaaaaaacaatccccaggggttctatgaccctattgactcctacagttctttcccttctcttggcaatggaagctccagtacccagattggagattaggatgagacaactttgtgtatatgtgcacgtgtgtggtgtgtgtgtgttttattaaggactaagatacacacttatctattctgtctccttctagcttttaggcagcctactcttggaaactggaggaaactgccctgagaattattagaatgctaataatagtaattggtaacattaacaatcagtgttagacaacagtgaggcatatcatgtgtttttattaaaaatgataaagatgtgtttcttctcatctaaaggaggtaactttgtgataattagtttgattaaaagtttgaagtatgaggactccttgttatgcctttaaggtaatttttaaaaaaaatctgagtagagatagtactaatattggcaagaaggtccccaggatagacctagcaaggagataagaatagatcattaaaaaataaatataaatggattggatagaattcccattcagctgttttaacacagaaattcaaaatagtgacttaacatggaagctatttctctcttacttaaaggcaaactggttttacagctctggtgtgtgatgttaccagacgcctaggccctctcctgttgctctgtcatcctaatgtgctgcatccacctcatggaccaagatggctgccacagctcctgccatcacatttacatttaagatagtagagaggaagtggagggaagttgcacatattgcttccagtcacatctcatgggttaaaacctagacatttgccacatctagctgcaaagaaggctagggaatgtctttattattgattgtcatgtgccttgataagcataggaggttctgttattaaagaaacaatgtgaaataatgtggaaattaatactgataaagactatcagtatctgatacaaaagggaaccaaacgatatttaagtgctttttaatgtcacttacttcatcatatgttttgcgaaagataagactaaaattcatcactttgtgtagcatttaatggttttcagaacatttttgcatgtgctgtctcatttggtcctcattacattcttgtgtgctaaataggacctctattcattacaccacttgctagtttgggatggagagtcagatatgttgaaagatttcccaacgactctaatttatgagcaagaaagttgcttagagccccagccttttgacttcatagtctttccgactactttatgcagctcagcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaatgcacatgaacccatcttcacagcatgtgaaagaaccaacctgcctggcagaggtgcagaaatttccagaggactggcctagctataaacaccagcaacatctgcaacacaaaagcccttgaacttctaggcaaggactcatgctaacctagcagtactccagattgagaacgcagatggacaggtgtctcttgagcctgtgttccaagatgtctgtggaaaggattgcaactgtcatcctttggcacactcagtggaacctgtgtgagctacatgttctgctgcattatgggaactcatcaaagggccagattgacatcttgccagaaaaaccagtgttttgaggagcaaaagttttgtgtacttcagtaattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaagagc

SEQ ID NO: 140219 - DNA, 411 bp, Homo sapiens
  Payload ID: 7508
  Gene Symbol: HSPG2
  Gene Name: heparan sulfate proteoglycan 2
  ENST ID: ENST00000374676
  CDS Start-End: 1-328
cgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattt

SEQ ID NO: 140220 - DNA, 14327 bp, Homo sapiens
  Payload ID: 7508
  Gene Symbol: HSPG2
  Gene Name: heparan sulfate proteoglycan 2
  Uniprot ID: P98160
  ENST ID: ENST00000374695
  CDS Start-End: 81-13256
ggccggcgagcgggcggctgcgggcggcgcggagcgggcggcgcggagcgagcgagcgagagagcggcgcgggccgggccatggggtggcgggcggcgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcc

SEQ ID NO: 140221 - DNA, 589 bp, Homo sapiens
  Payload ID: 7508
  Gene Symbol: HSPG2
  Gene Name: heparan sulfate proteoglycan 2
  ENST ID: ENST00000427897
  CDS Start-End: 1-589
cacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggtcagtccgaatccctgtccctgcggggcctgctctgccccgctgcccagaccctgcggggaaatcaggcagcatctggtggaagccgagacctgggcatggggggcagggcatgggggacagggcaggggctgcccg

SEQ ID NO: 140222 - DNA, 921 bp, Homo sapiens
  Payload ID: 7508
  Gene Symbol: HSPG2
  Gene Name: heparan sulfate proteoglycan 2
  ENST ID: ENST00000635682
  CDS Start-End: 1-921
acaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatggcctccttctctactcggggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaag

SEQ ID NO: 140223 - DNA, 5236 bp, Homo sapiens
  Payload ID: 7509
  Gene Symbol: HGSNAT
  Gene Name: heparan-alpha-glucosaminide N-acetyltransferase
  Uniprot ID: Q68CP4
  ENST ID: ENST00000379644
  CDS Start-End: 43-1950
gggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaa

SEQ ID NO: 140224 - DNA, 757 bp, Homo sapiens
  Payload ID: 7509
  Gene Symbol: HGSNAT
  Gene Name: heparan-alpha-glucosaminide N-acetyltransferase
  ENST ID: ENST00000524016
  CDS Start-End: 1-757
tatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcagtgctgcccagactgggtcaccaaacaggcctgtctgacggaacccttgtcacctttgtggagaattctctttgggccctgcctggaagtaagagccacggagcctgcccaggcaggaaaaatactattgtattacaaggctcggaccaaagacatcctgattcgattcactgcttggtgttgtattctt

SEQ ID NO: 140225 - DNA, 2332 bp, Homo sapiens
  Payload ID: 7509
  Gene Symbol: HGSNAT
  Gene Name: heparan-alpha-glucosaminide N-acetyltransferase
  ENST ID: ENST00000521576
  CDS Start-End: 288-1346
atttcccagacggggtggttgccggacggaggggctcctcacttctcagacggggcggttgccaggcagagggtttcctcacttctcagacggagcggccgggcagagacgctccccacctcccagacagggctgcggcccagcagaggcactcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccaagtgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactc

SEQ ID NO: 140226 - DNA, 1451 bp, Homo sapiens
  Payload ID: 7509
  Gene Symbol: HGSNAT
  Gene Name: heparan-alpha-glucosaminide N-acetyltransferase
  ENST ID: ENST00000520704
  CDS Start-End: 144-662
gggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagagtcttgctatgtcacccaggctggagtgcggtggcaccatctcggctcactccaagctctgcctcccgggttcacaccattctcctacctcagcctcctgagtagctggaactgcagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtgagttgccggtctgccctcttctcttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctcaaaaaaaaaaaaataa

SEQ ID NO: 140227 - DNA, 491 bp, Homo sapiens
  Payload ID: 7509
  Gene Symbol: HGSNAT
  Gene Name: heparan-alpha-glucosaminide N-acetyltransferase
  ENST ID: ENST00000517319
  CDS Start-End: 1-294
atgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcacgttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagagtcttgctatgtcacccaggctggagtgcggtggcaccatctcggctcactccaagctctgcct

SEQ ID NO: 140228 - DNA, 560 bp, Homo sapiens
  Payload ID: 7509
  Gene Symbol: HGSNAT
  Gene Name: heparan-alpha-glucosaminide N-acetyltransferase
  ENST ID: ENST00000522082
  CDS Start-End: 9-560
ttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcgactggtccctcactcctggcttcaagtgatcctcctgccttggccacccaaagcgccgggattacaggagaggagctgcctttctcttcgagacatcacgtccagctggccccagtggctgctcatcctggtgctggaaggcctgtggctgggcttgacattcctcctgccagtccctgggtg

SEQ ID NO: 140229 - DNA, 4615 bp, Homo sapiens
  Payload ID: 7510
  Gene Symbol: HPSE
  Gene Name: heparanase
  Uniprot ID: Q9Y251
  ENST ID: ENST00000311412
  CDS Start-End: 101-1732
aaggagaaaagggcgctggggctcggcgggaggaagtgctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttga

SEQ ID NO: 140230 - DNA, 4652 bp, Homo sapiens
  Payload ID: 7510
  Gene Symbol: HPSE
  Gene Name: heparanase
  Uniprot ID: Q9Y251
  ENST ID: ENST00000405413
  CDS Start-End: 138-1769
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttga

SEQ ID NO: 140231 - DNA, 1678 bp, Homo sapiens
  Payload ID: 7510
  Gene Symbol: HPSE
  Gene Name: heparanase
  Uniprot ID: Q9Y251
  ENST ID: ENST00000509906
  CDS Start-End: 138-1280
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 140232 - DNA, 1458 bp, Homo sapiens
  Payload ID: 7510
  Gene Symbol: HPSE
  Gene Name: heparanase
  Uniprot ID: Q9Y251
  ENST ID: ENST00000513463
  CDS Start-End: 1-1458
atgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaaaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctga

SEQ ID NO: 140233 - DNA, 1450 bp, Homo sapiens
  Payload ID: 7510
  Gene Symbol: HPSE
  Gene Name: heparanase
  ENST ID: ENST00000508891
  CDS Start-End: 138-644
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaacttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 140234 - DNA, 1571 bp, Homo sapiens
  Payload ID: 7510
  Gene Symbol: HPSE
  Gene Name: heparanase
  Uniprot ID: Q9Y251
  ENST ID: ENST00000512196
  CDS Start-End: 138-1547
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 140235 - DNA, 1624 bp, Homo sapiens
  Payload ID: 7510
  Gene Symbol: HPSE
  Gene Name: heparanase
  ENST ID: ENST00000507150
  CDS Start-End: 138-818
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 140236 - DNA, 1849 bp, Homo sapiens
  Payload ID: 7511
  Gene Symbol: HPSE2
  Gene Name: heparanase 2 (inactive)
  Uniprot ID: Q8WWQ2
  ENST ID: ENST00000370546
  CDS Start-End: 1-1647
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaaaacccaaagatgtcaatactgtgggatcatctgaatctaaaagggcattacctaattcttcagaagaaaggtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataa

SEQ ID NO: 140237 - DNA, 2121 bp, Homo sapiens
  Payload ID: 7511
  Gene Symbol: HPSE2
  Gene Name: heparanase 2 (inactive)
  Uniprot ID: Q8WWQ2
  ENST ID: ENST00000370549
  CDS Start-End: 61-1665
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 140238 - DNA, 2295 bp, Homo sapiens
  Payload ID: 7511
  Gene Symbol: HPSE2
  Gene Name: heparanase 2 (inactive)
  Uniprot ID: Q8WWQ2
  ENST ID: ENST00000370552
  CDS Start-End: 61-1839
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 140239 - DNA, 3681 bp, Homo sapiens
  Payload ID: 7511
  Gene Symbol: HPSE2
  Gene Name: heparanase 2 (inactive)
  ENST ID: ENST00000404542
  CDS Start-End: 15-1184
tctgcttcttcccagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaactccttcttctctgcctctttcttgctgctgccctgagttttttgacacatctctttccataggggagtaatgggtgtgtcagccctggcctgctgggagagctgtttgtatgatttcccggctgatgtatgagcgtgcgcatctgggttcctgacagtggcatccatcactggcagttcttctgggaagcgggtgcttcaaaagtaaaattacaatcacactccagatttggtaagaaggttctattcctctgtgaatccagattcccccagagttgtaatgggagtcaagtaacaatattcattgagtggagagcagtttattaggcacaacaaaaagtagtcatcattcttcatgttgctatgagggagagtttgagtacaaagagaaagcatactgaaacatcaggtacacacacacaccccaactggacaaagcaaattagacctctccaaaattaagagaatattaggggctctatagggtaagcccttaattgtttggttaactcaaatcattatttttaaaaaagaagaaaaaagtgtgaatcaaggtcatcactggaagacacaactgaatctaacctttttgcctcttcccaagtagcctatttgagctagaacaaaactttgttagccattttgggagagaatagggaatctagagaatgaagatctggccaaaactatggaatggtaggtaggaagcttctgagttgggcaggtgtgaagtgggggatgaggacgttctatatgattcaaggggcatgagggtctttgccaatgagctacagctgaaatgactttcttttctgtggatgtgattttctttctcaggataaatgacaggaatgatgcttttgttagaaggaggagagatttgacactgttccaagtgagacggtgatacaatttctgctgtttgtgaaaggacaggaatggggcgggggcaaggcagggttgcctagggcagagactagggaggctgcctaagacgcacacggagttaaggatttgggccaagtctgcaaagtgagagatggaagggagattagaccaaagaggagggagagaattctgagcttggagaacggtggatttgggagagggaagctgactacctaattccaggaagcgaggggaccgggttttgacatgcttatcattaagcacaggaggaacagcatacagcagatgtactacagcgagcaagaaagggagagcccgaggaccaggctgcaccaggtcagtggctgtgctcagcatggaagcaactggagagagaggggcagaccctgagaccgccctgcaaggctgcccagaagggacccgtttctctgggaccaggcacctcccactgaggcttcagctctgagagggcaggaaagtgaagtaccaagatgggggcggggcggggggtaggaaataagagaaagaagaaacagattgacaggccaaagtgaggaaaagagaggaaaagagaaatgagactaaaaggtcgttcccccaactgttaaaaatgtgtgcagatatcaacgtctcttctacatactggtacaggtgcgactgcagggccccctgatataacaagagtaaccaaaggtccctaagagcctggccctggggacctatggtttgctttgcgtccttagtaaccccatgataaaggggtactactgttatccccatttttcctacgaggcatggagaggatccatggctcgcccaggggcacccggggaaatgggttgccgagcgcgaaataatccagagcctgcccactcagccacaaggctcagcggctccacaggtccagacacctccttcacatctttgtaggttctgctcattcagaacagccagaactccactcaaacacactttctgtaaataagtgttgatttttttttactaaaccttgcagaatatgggtaattcctgcttcttttatctttctctgtgtattaaatgctgctctcacgagatttaagttttgtttattttttagttaataaaaggaagagggaattactgaaattta

SEQ ID NO: 140240 - DNA, 447 bp, Homo sapiens
  Payload ID: 7511
  Gene Symbol: HPSE2
  Gene Name: heparanase 2 (inactive)
  ENST ID: ENST00000614306
  CDS Start-End: 1-447
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggat

SEQ ID NO: 140241 - DNA, 1760 bp, Homo sapiens
  Payload ID: 7511
  Gene Symbol: HPSE2
  Gene Name: heparanase 2 (inactive)
  Uniprot ID: Q8WWQ2
  ENST ID: ENST00000628193
  CDS Start-End: 61-1503
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaga

SEQ ID NO: 140242 - DNA, 2386 bp, Homo sapiens
  Payload ID: 7512
  Gene Symbol: HBEGF
  Gene Name: heparin-binding EGF-like growth factor
  Uniprot ID: Q99075
  ENST ID: ENST00000230990
  CDS Start-End: 304-930
attcccggccgcgagccgggcagcgctcattcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaagttatgctgtcatggtcctttctggaagtttctggtgccatttctgaactgttacaacttgtatttccaaacctggttcatatttatactttgcaatccaaataaagataacccttattccata

SEQ ID NO: 140243 - DNA, 3602 bp, Homo sapiens
  Payload ID: 7513
  Gene Symbol: HEPACAM
  Gene Name: hepatic and glial cell adhesion molecule
  Uniprot ID: Q14CZ8
  ENST ID: ENST00000298251
  CDS Start-End: 407-1657
gttaggtggagacagggtaggttgggacacaaagtccagttaagtgtgtgtcccagctcagtgctctgagcccagatcctcatctccctgggtagtgaggctcagcacagacaagcaaccaactgctgggctgccggtgccccccatgttggaacctgagttggagattatctcctaagcagatacctgcttccaaactggggatgtagggcttggaaactagaaaatgccaggtctgagggagaggaaagaacaagtccagcaatacacagagctctgtgtattcagagggaagttggcagggttgtgttcgggcagagaaactccgagtggtacaaaggggacgtgcccagagtggagaaatcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctgagccgcctcgggatcccctgagaggcgcccgcggtctgcggccagtggcccgggggaaagctggggctgggaagcccgggcgcggcgcgctggggacgaggggaggtcccgggggggcgctggtgtctcgggtgtgaacgtgtatgagcatgcgcagacggaggcgggtgcgcggaggcggcagtgttgatatggtgaaaccgggtcgcatttgcttccggtttactggctgtgtcctcacttggtataggttgtgccctcttaggaccacatagattattacatttctggcccaatacccaaaagggttttatggaaactaacatcagtaacctaacccccgtgactatcctgtgctcttcctagggagctgtgttgtttcccacccaccacccttccctctgaacaaatgcctgagtgctggggcactttttttttttttttttttttttttttttttgcaagttcagattagagaggccactttcccagaatccacagctgcactaagctaaggagaagccagatgccggttactgggtgtgcaggggctgttctgagctggggggatcattgtgaaggccttcttccctgggcacctggtacctggggacctacaaggtggtgagggaagggtacgagtacattccttttccctctgacctgggcgctagcaagggcaaagaacccgagcctgccagcttggcctcctcccacagcctccctcggaggcatgccatgccaagcactctttctgtctctgttcatgaataaaagagatggatgggcttattcttatagagaagtgaatttcacttactcccctggcccgaaaactagaccaaatgaggaactgttttagctcatcaaactcatatattcctcctggcttccttacaaaacaagcctttcaaacaatcattgtcctcaggaaagttgttgagcttcctccagctgtgagaataagtcctaatctccagagaaatggtggggggaggaggaggcttattgcttcccagcatttggggggaacatgatccaacccctggcctcctgccacccatctgccctgctcccacatgctcaggtcccagggcacagaaaaagggcagactccctaatcacactaacatcaaaataaagaggctgggccgctgtgtagccaggacatgcccatgccaccgcctattgaacagttcataggagtggcagtaatctactgtgtgaggagagagggcaattaaaaagctgaaagagaaggaggccctctgtgtattccattccctcctccttaatgcctccaagggtccttgcatccctagtctcctaaactccagctctgattcgccatcaacccatggagcaattccaaggccccagttacccatcacctccacaccaggtcaagttttgtctcagccccaaaggcactgacatttctagtttgccccctctgccctgaaccccacagcatgcctgtctcagctccctgtccctcggcacttccccaggctcatttgagcaggtgtgccttcgcagctcccctaaacttcccaggtgcctcatccataatgagataatgcatgtaggggaaaagtttctcaagaaggtggaagaggcagcaggacttggataaggagtacctgctggtcagccttgagatgcacaggtgaaggttagggtgagatgagaacatgccataccctggtgctgaatccctgaggggccagcttgccaggcttaagccaaatctgccttaaattgggggtggggaggggtaagtaaggaagtggggtttgtttttgtgttgttttcatcttcatctttgtattactagcatccagcagagtgcctagcacatactggatgctcaataaacttttgatgaaatgaaatgacaactttattccacataaacaagggtaacaaaacaagctgcttaaata

SEQ ID NO: 140244 - DNA, 5547 bp, Homo sapiens
  Payload ID: 7514
  Gene Symbol: HLF
  Gene Name: hepatic leukemia factor
  Uniprot ID: Q16534
  ENST ID: ENST00000226067
  CDS Start-End: 474-1361
tgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttc

SEQ ID NO: 140245 - DNA, 1385 bp, Homo sapiens
  Payload ID: 7514
  Gene Symbol: HLF
  Gene Name: hepatic leukemia factor
  Uniprot ID: Q16534
  ENST ID: ENST00000430986
  CDS Start-End: 218-850
acatttaaaagagcttcgggcacccggcctccctgggtcccgctcctgcggcgcgggtgggaggtgtaacttgacagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttat

SEQ ID NO: 140246 - DNA, 1310 bp, Homo sapiens
  Payload ID: 7514
  Gene Symbol: HLF
  Gene Name: hepatic leukemia factor
  ENST ID: ENST00000570962
  CDS Start-End: 277-510
aaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaa

SEQ ID NO: 140247 - DNA, 2977 bp, Homo sapiens
  Payload ID: 7514
  Gene Symbol: HLF
  Gene Name: hepatic leukemia factor
  Uniprot ID: Q16534
  ENST ID: ENST00000573945
  CDS Start-End: 235-867
actttcccggtgcactttttctggtgggaggggagagcggagcaggctcacgtgtaaccgcgcaggagcctcctctggcttgagccctttcttgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatggga

SEQ ID NO: 140248 - DNA, 3589 bp, Homo sapiens
  Payload ID: 7514
  Gene Symbol: HLF
  Gene Name: hepatic leukemia factor
  Uniprot ID: Q16534
  ENST ID: ENST00000575345
  CDS Start-End: 301-933
ctgaacttttaactctagatctacaaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgta

SEQ ID NO: 140249 - DNA, 1251 bp, Homo sapiens
  Payload ID: 7514
  Gene Symbol: HLF
  Gene Name: hepatic leukemia factor
  ENST ID: ENST00000572002
  CDS Start-End: 1-711
cagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagtt

SEQ ID NO: 140250 - DNA, 1845 bp, Homo sapiens
  Payload ID: 7515
  Gene Symbol: HAVCR1
  Gene Name: hepatitis A virus cellular receptor 1
  Uniprot ID: Q96D42
  ENST ID: ENST00000339252
  CDS Start-End: 534-1628
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaa

SEQ ID NO: 140251 - DNA, 1449 bp, Homo sapiens
  Payload ID: 7515
  Gene Symbol: HAVCR1
  Gene Name: hepatitis A virus cellular receptor 1
  Uniprot ID: Q96D42
  ENST ID: ENST00000523175
  CDS Start-End: 48-1142
cccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagttttctctcaaatatgaacactttataattgtatgttctttttagaccccataaatcctgtat

SEQ ID NO: 140252 - DNA, 774 bp, Homo sapiens
  Payload ID: 7515
  Gene Symbol: HAVCR1
  Gene Name: hepatitis A virus cellular receptor 1
  ENST ID: ENST00000518745
  CDS Start-End: 106-774
agagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaa

SEQ ID NO: 140253 - DNA, 1713 bp, Homo sapiens
  Payload ID: 7515
  Gene Symbol: HAVCR1
  Gene Name: hepatitis A virus cellular receptor 1
  ENST ID: ENST00000522693
  CDS Start-End: 333-1538
agtgctattactgcatatgatgtaggtttagttttccaagttcttccgtggccctttttgcttattatatcaatccttggtgggagatagaggaagcatttttagtgctattttacaactgaggaaatagaggtttgaagagaactcaggaactctcagggttacccagcattgtgagtgacagagcctggatctgaacagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagttttctctcaaatatgaacactttataattgtatgttctttttagaccccataaatcctgtatacatcaaagagaa

SEQ ID NO: 140254 - DNA, 1807 bp, Homo sapiens
  Payload ID: 7515
  Gene Symbol: HAVCR1
  Gene Name: hepatitis A virus cellular receptor 1
  ENST ID: ENST00000625904
  CDS Start-End: 534-1739
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgct

SEQ ID NO: 140255 - DNA, 2907 bp, Homo sapiens
  Payload ID: 7516
  Gene Symbol: HAVCR2
  Gene Name: hepatitis A virus cellular receptor 2
  Uniprot ID: Q8TDQ0
  ENST ID: ENST00000307851
  CDS Start-End: 732-1637
agaatattagaacagagagccatgcatgtattatctaatacaattttctcattttataaattatataaatgaggaaactgagactcagcaaggttataggatacaacctaatctgtgttagaagaaggatgagagtgaggcttatgctgggagttgctatggtctgtaaatgtgaggataaggaacatgccattcactgttgtgttccacttcctagtccagtgcctggtgcaaagtaggggcttcataaactttggtcacaggcctgatgaagggactgatttgagtgaatgaatccatggatgatgcatctgtactttgtgttccccgctagtcagatggactcggacatgctccatttcaggtgtatctcatctgagacattattagagggttctctttatgtgccatgactgagtagcgttttcttccactgaagtattgcttcctctttgttgatatcacaggacagacatcagaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 140256 - DNA, 566 bp, Homo sapiens
  Payload ID: 7516
  Gene Symbol: HAVCR2
  Gene Name: hepatitis A virus cellular receptor 2
  ENST ID: ENST00000524219
  CDS Start-End: 344-566
gtttcggctgcagaggggaaggcggctaccagtgtaaagccagagctgagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgact

SEQ ID NO: 140257 - DNA, 975 bp, Homo sapiens
  Payload ID: 7516
  Gene Symbol: HAVCR2
  Gene Name: hepatitis A virus cellular receptor 2
  ENST ID: ENST00000522593
  CDS Start-End: 140-961
gtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccacctta

SEQ ID NO: 140258 - DNA, 1434 bp, Homo sapiens
  Payload ID: 7517
  Gene Symbol: HEPN1
  Gene Name: hepatocellular carcinoma, down-regulated 1
  Uniprot ID: Q6WQI6
  ENST ID: ENST00000408930
  CDS Start-End: 508-774
tttcatttcatcaaaagtttattgagcatccagtatgtgctaggcactctgctggatgctagtaatacaaagatgaagatgaaaacaacacaaaaacaaaccccacttccttacttacccctccccacccccaatttaaggcagatttggcttaagcctggcaagctggcccctcagggattcagcaccagggtatggcatgttctcatctcaccctaaccttcacctgtgcatctcaaggctgaccagcaggtactccttatccaagtcctgctgcctcttccaccttcttgagaaacttttcccctacatgcattatctcattatggatgaggcacctgggaagtttaggggagctgcgaaggcacacctgctcaaatgagcctggggaagtgccgagggacagggagctgagacaggcatgctgtggggttcagggcagagggggcaaactagaaatgtcagtgcctttggggctgagacaaaacttgacctggtgtggaggtgatgggtaactggggccttggaattgctccatgggttgatggcgaatcagagctggagtttaggagactagggatgcaaggacccttggaggcattaaggaggagggaatggaatacacagagggcctccttctctttcagctttttaattgccctctctcctcacacagtagattactgccactcctatgaactgttcaataggcggtggcatgggcatgtcctggctacacagcggcccagcctctttattttgatgttagtgtgattagggagtctgccctttttctgtgccctgggacctgagcatgtgggagcagggcagatgggtggcaggaggccaggggttggatcatgttccccccaaatgctgggaagcaataagcctcctcctccccccaccatttctctggagattaggacttattctcacagctggaggaagctcaacaactttcctgaggacaatgattgtttgaaaggcttgttttgtaaggaagccaggaggaatatatgagtttgatgagctaaaacagttcctcatttggtctagttttcgggccaggggagtaagtgaaattcacttctctataagaataagcccatccatctcttttattcatgaacagagacagaaagagtgcttggcatggcatgcctccgagggaggctgtgggaggaggccaagctggcaggctcgggttctttgcccttgctagcgcccaggtcagagggaaaaggaatgtactcgtacccttccctcaccaccttgtaggtccccaggtaccaggtgcccagggaagaaggccttcacaatgatccccccagctcagaacagcccctgcacacccagtaaccggcatctggcttctccttagcttagtgcagctgtggattctgggaaagtggcctctctaatctgaacttg

SEQ ID NO: 140259 - DNA, 5989 bp, Homo sapiens
  Payload ID: 7518
  Gene Symbol: HGF
  Gene Name: hepatocyte growth factor (hepapoietin A
  scatter factor)
  Uniprot ID: P14210
  ENST ID: ENST00000222390
  CDS Start-End: 228-2414
gaggaaaggagggggctggaagagagtaaagggctgttgttaaacagtttcttaccgtaagagggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtgcatgcactacagtttaaattatggtgtacctaatgtaacccctaaatattttagaagtatgtacctatagttttacctcaaaaaaaccagaaatctctaaagaccagtagaaatattaaaaaatgatgcaagatcaaaatgattagctaattctccatacataatctgcagatgatcttctttggttggcatttcaggtgtggccatcacccagagttaaataacacctaatctaggtgtttacatgtattcattatcctagttatttcatgtagtttctaattcttaaaggaaagagggtaatagttctatttgtgtaatttgtttcctccaaacttaaggccacttatttacacaagatatttgtagatctattttcctaaagcatttcttaagtgctcagatcagtatctaattgaagaagtttaaaagtgttttggtcattaaaaatgtacttaaataggttaaatctaagccttgctgctgtgattggcttctagctcactgcctttaaattttaaaaaatttaagaggaaaatttccaagtctccaaagttttataaatacccttcatcaagtcatgcattaaagtatatattggagaaaaaaataaaaatacttttctcaacctggaagattttagcctaataaagcttttttgaagtaaaagacaacttgtaaaaggaaagaaactagtttgtctcaactctgtattcatttattttttttttgaagtagagtggaatctgttgaatcagatattttatcaagatatgtttattttttcttatttcattttacaaagttcactcctaatgccatatgtaacagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatacagctaagtatttagacattttgaggctagtatttttcattttattaaaggctaaaaacaataccaccaataaatcatcaaacaaaccgtacaaagtaattctctctttgggaggctcctttcgtgatagagggacatgggtggaattgacaatgaaacttagatgaacaaggtccatgttattttaggtggtagaacagggtagagtcatgtcattatttgctggtggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaattaataagctgcctattgagtggtatagctgtatgcttacccaaaaaagggaacactgtggttatgacttgtattataaactttctgtagttaataaagttgttatttttataaccatgattatattattattattaataaaatattttatcaaaatgct

SEQ ID NO: 140260 - DNA, 1425 bp, Homo sapiens
  Payload ID: 7518
  Gene Symbol: HGF
  Gene Name: hepatocyte growth factor (hepapoietin A
  scatter factor)
  ENST ID: ENST00000354224
  CDS Start-End: 1-555
atgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagtggtggtgatgactgccttgttgaatccactttttattctattccattttggggacacaattctgcaagatgattcttcattaggaaacagagatgagttattgaccaacacagaaagaaaaagagtttgttgctccacactgggattaaacctatgatcttggcctaattaacactagctagtaagtgtccaagctgatcatctctacaacatttcaataacagaaaacaacaattttcaaaattagttacttacaattatgtagaaatgcctctaaaacacagtattttccttatattacaaaaacaaaaattataattggttttgtcctcttttgagagtttgcatggtgttactccctgcatagtgaagaaaacattttatttaagtagatggatctaagtttttcatgaacaaaggaatgacatttgaaatcaatcctaccctagtccaggagaatgcattagattaacctagtagaggtcttatttcaccctgagttttctatgatcgtgattctctgctggaggagtaattgtgaaatagatctctctgggaactggcttcctagtccaatcagctcttttaccaatgaacacttccttgtgatatagatgtttatggccgagaggatccagtatattaataaaatccctttttgtattcaatgagggaaacacataattttcatcaattagcagcttattggaatatctgcatgatggtttaacacttttaagtgttgactaaagattaattttacagaaaatagaaaaagaaatatgtttctgtctggaggaatgatttattgttgacccctaaattgaaatattttactagtggcttaatggaaagatgatgaaagatgatgaaattaatgtagaagcttaactagaaaatcaggtgacctgatatctacatctgtatccttcattggccacc

SEQ ID NO: 140261 - DNA, 545 bp, Homo sapiens
  Payload ID: 7518
  Gene Symbol: HGF
  Gene Name: hepatocyte growth factor (hepapoietin A
  scatter factor)
  ENST ID: ENST00000421558
  CDS Start-End: 191-545
attgagcgaattggtcccctgcctgtgccttgatttagccattgggctcagccttgctcctcccttccttactcggataggagccactgggatctggagctccagcttccaaattgaagctggcctcaggccaggtgaccttttctttgcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctct

SEQ ID NO: 140262 - DNA, 1184 bp, Homo sapiens
  Payload ID: 7518
  Gene Symbol: HGF
  Gene Name: hepatocyte growth factor (hepapoietin A
  scatter factor)
  Uniprot ID: P14210
  ENST ID: ENST00000444829
  CDS Start-End: 61-933
caggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacctagcttttctgaatttacaataaaaactattttttaacgtg

SEQ ID NO: 140263 - DNA, 2249 bp, Homo sapiens
  Payload ID: 7518
  Gene Symbol: HGF
  Gene Name: hepatocyte growth factor (hepapoietin A
  scatter factor)
  Uniprot ID: P14210
  ENST ID: ENST00000457544
  CDS Start-End: 78-2249
taggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatag

SEQ ID NO: 140264 - DNA, 721 bp, Homo sapiens
  Payload ID: 7518
  Gene Symbol: HGF
  Gene Name: hepatocyte growth factor (hepapoietin A
  scatter factor)
  ENST ID: ENST00000453018
  CDS Start-End: 346-522
gaaatctagtatattgtcaagtaaaatcactttcttgtagatgatccttaggattttttttatatatgagccttaaaaacatttctccaatgtttatttttttaaaacattttgtatttaatagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacaggtaagaacagtatgaagaaaagagatgaagcctctgtcttttttacatgttaacagtctcatattagtccttcagaataattctacaatcctaaaataacttagccaacttgctgaattgtattacggcaaggtttatatgaattcatgactgatatttagcaaatgattaattaatatgttaataaaatgtagccaaaacaa

SEQ ID NO: 140265 - DNA, 590 bp, Homo sapiens
  Payload ID: 7518
  Gene Symbol: HGF
  Gene Name: hepatocyte growth factor (hepapoietin A
  scatter factor)
  ENST ID: ENST00000412881
  CDS Start-End: 166-590
attgggctcagccttgctcctcccttccttactcggataggagccactgggatctggagctccagcttccaaattgaagctggcctcaggccaggtgaccttttctttgattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctat

SEQ ID NO: 140266 - DNA, 1111 bp, Homo sapiens
  Payload ID: 7518
  Gene Symbol: HGF
  Gene Name: hepatocyte growth factor (hepapoietin A
  scatter factor)
  Uniprot ID: P14210
  ENST ID: ENST00000453411
  CDS Start-End: 44-901
ggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctttatagctgatccctacctctctcgctgtctttgtacccagcctgcattctgtttcgatctgtcttttagcagtccatacaatcatttttctacatgctggcccttacc

SEQ ID NO: 140267 - DNA, 1990 bp, Homo sapiens
  Payload ID: 7518
  Gene Symbol: HGF
  Gene Name: hepatocyte growth factor (hepapoietin A
  scatter factor)
  Uniprot ID: P14210
  ENST ID: ENST00000423064
  CDS Start-End: 135-767
cacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcgagttatcagtttgaatttcaacactgcctgagacatccctctggggaaagtgaaagagagggtttacttacctactgtcttgagctcacatacctcaaaatctactactgtgtggcacctgaaaggagttgaatgaagcttagcctttcattagcaatgttaattctattcaaccagcacctgcttccacagaaattctgtccaaactatcatgaagtggtgtgacaagggtatatggacccagaagataatacaatataagaagggatcactggaagcttgaccccatgcacattttggtgaaaatgtgcctagaatcaaatgtgacacgtaggctggaactgagtaccattcagaataggatctgaagagatcaaagcaatggagaccaccaaactgtcttgaaggcatgtctatggaccttaagtccatgtctatgttttcagctcttctcacagcataaaagggcattgtccttacttttgcagtggaaaactgaatggctgacaagatggaagagtaaccatttcagcattgtatgtggtttcatttttcttagttatctggctactgaatagccggatttttcagttctgtcagaaactctaaatttccaaaaatctaagtgaaacatggatgaaactctgttagaaaattgttaggattttggagtatttggggagggggactactggaatgctgtccaagttttatactaagatatcttacctgtttgttattaaccaaatatttttaaaaatatttcctccataaatattcatttaatattaggttgatatttatcacataaaaagtaaaggctactgttagctaattgtcacagagaaggatttgttttctgttgttagtgaatttgaaatccttgactttatgtgctacagccagttccatctctgtttgtaaattcttactttccattccatatcatattctgttccctataacctcttcattgttttcttttcttttaaaaataataaacttttctatgatcacgttttgaaca

SEQ ID NO: 140268 - DNA, 2970 bp, Homo sapiens
  Payload ID: 7519
  Gene Symbol: HGS
  Gene Name: hepatocyte growth factor-regulated tyrosine kinase substrate
  Uniprot ID: O14964
  ENST ID: ENST00000329138
  CDS Start-End: 136-2469
cctcgcggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaag

SEQ ID NO: 140269 - DNA, 716 bp, Homo sapiens
  Payload ID: 7519
  Gene Symbol: HGS
  Gene Name: hepatocyte growth factor-regulated tyrosine kinase substrate
  ENST ID: ENST00000577012
  CDS Start-End: 503-716
cgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaaacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggagg

SEQ ID NO: 140270 - DNA, 878 bp, Homo sapiens
  Payload ID: 7519
  Gene Symbol: HGS
  Gene Name: hepatocyte growth factor-regulated tyrosine kinase substrate
  ENST ID: ENST00000571237
  CDS Start-End: 1-878
agacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccag

SEQ ID NO: 140271 - DNA, 547 bp, Homo sapiens
  Payload ID: 7519
  Gene Symbol: HGS
  Gene Name: hepatocyte growth factor-regulated tyrosine kinase substrate
  ENST ID: ENST00000573320
  CDS Start-End: 1-191
gctaccagccttacaacatgcagaatctcatgaccaccctcccaagccaggatgcgtctctgccaccccagcagccctacatcgcggggcagcagcccatgtaccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctggg

SEQ ID NO: 140272 - DNA, 824 bp, Homo sapiens
  Payload ID: 7519
  Gene Symbol: HGS
  Gene Name: hepatocyte growth factor-regulated tyrosine kinase substrate
  ENST ID: ENST00000572392
  CDS Start-End: 35-824
cgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggc

SEQ ID NO: 140273 - DNA, 644 bp, Homo sapiens
  Payload ID: 7519
  Gene Symbol: HGS
  Gene Name: hepatocyte growth factor-regulated tyrosine kinase substrate
  ENST ID: ENST00000571518
  CDS Start-End: 468-644
gcgaggggagaggaagtgcccgtggagggcggcaggccccctcatcccgcgccaattatcctcagctcgggccgtcccccgctcccgaaggctggccttaagtcacgacctgacccgctgcgcctcggcgtgcacttagaggagcccggagctcttcgccaagcgcagaactgaccccccgcaactccacccgcgggggcggacacctaccgtgggccgtgtcgggggcggctcccccaggtcgcctttcccatcccgggagctcacctgtgcgaagcggtcaaggacccgagcagctaaaggacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaag

SEQ ID NO: 140274 - DNA, 330 bp, Homo sapiens
  Payload ID: 7519
  Gene Symbol: HGS
  Gene Name: hepatocyte growth factor-regulated tyrosine kinase substrate
  ENST ID: ENST00000575078
  CDS Start-End: 1-330
cccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagggggagacgcatacccgaggccccttctcagcagacagaacgaggacacaagtctcagggcagatacgcgcatccgcaagtgtagacaggaaaaaccgtgaattt

SEQ ID NO: 140275 - DNA, 523 bp, Homo sapiens
  Payload ID: 7519
  Gene Symbol: HGS
  Gene Name: hepatocyte growth factor-regulated tyrosine kinase substrate
  ENST ID: ENST00000570652
  CDS Start-End: 1-116
agcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcga

SEQ ID NO: 140276 - DNA, 6445 bp, Homo sapiens
  Payload ID: 7520
  Gene Symbol: HNF4A
  Gene Name: hepatocyte nuclear factor 4, alpha
  Uniprot ID: P41235
  ENST ID: ENST00000316099
  CDS Start-End: 90-1514
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaagtccttggataagtatcttttctttcaggtatcagaaataagactgaatcttctggttctacttgggggttaaaaaattttttttaaaggaagaatgagaatagttttatagttctttgtgatgtgcagaatgtttttgtgtccattataatttttcagtcttcacatcaagaggtaagcagttagacatgattactcccactttccagatgaggagactgaggcttgggggaagtgacttctcttggaaggcagaggtggacatctaaccctggtctcttgattccaagtacttagtatatcgagagagtgaaagttgatcccccttcttgaagaggggagtgatgaggggagagtgcaatggcaagatctggaagaatggcaagagggtccaagggtctgtcatcctccaccaaggttcaagacagaaccttttgctgggtcacctcaatctgccagcaatggaagatgagtagctgtggggacatttcataaaagcaagtggtttttttgttttgttttgttttgttttttgtttttttttctagaacaaggctgtgcacagtggctcacctctgtaatcccagcactttgggaggctgaggcgggaggatcacttgagctcaggagttcgagaccagccagagcaatataaggagaccccatctctacaaaaaatttaaaaattagccaggtatagtggtgtgtgcctatagtaccagctactctgaaggctgaggtgggaagattgcttcagcccaggagttcgaggatgcagtgagctatgaatgcaacactgcactacagcctggatgaaagaacaagactctgtctcaaaacataaataataagtaaaaagaataaaagcaagagatgcacttgagaatctccagccagatctgtagccactgggcttctctccaaggctaaactattacaggagggtggccttgtgtctcggtcaccacagaccacagcgttccattcactcggggttgtgctggagctggcttgtgagaactgactgttagcttctcttcccaactccatgtttgccagtgccacactgatagcttgaaattggttattgccggagtgtttacaccacaaggactagcaaactctacaaatccgggcttttgttcctggagagcccgttgttaacattcaccagcacaccacagcattcggcaatggctggaccatgggatgcctacatatggggacatcctccttggggatgagggtagagcagggcgatcctttcacctcttccttaagggaggggacaaaagttctggtctgggaagcacacgttttgctgatcagcgtaaccttgggcaggtcactccaccactccgagcctcatctgtaaagtgggaatgatatctccctccagggcagatgtcaggattcaatggaatgagatcacagtaactgtgagagctcccgttacatgaggagtacaagtgaactcttcatgcgcccctttttagcgagaagttaaccattaaactctccaggcttcagagcacccattcgctgtctacctgatccctagggccgctcccgccttcccctgtgccttccctccactagtcagcaccaggaaatgttttcgataacgttgcaacggaggccttgttcatgctgccgccatcggggacaagcgcgggggggggggggtggaggccagaggagactatttcagtcctaaattgtgcttaataaacccatatcaaaaccataaa

SEQ ID NO: 140277 - DNA, 1470 bp, Homo sapiens
  Payload ID: 7520
  Gene Symbol: HNF4A
  Gene Name: hepatocyte nuclear factor 4, alpha
  Uniprot ID: P41235
  ENST ID: ENST00000316673
  CDS Start-End: 106-1464
cactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 140278 - DNA, 3340 bp, Homo sapiens
  Payload ID: 7520
  Gene Symbol: HNF4A
  Gene Name: hepatocyte nuclear factor 4, alpha
  ENST ID: ENST00000372920
  CDS Start-End: 104-427
gcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgattttgttgccgctgcgtctcgccagattgaggcatcccctccgacatcactggagcatatctggaggggtggacagttctccacagggagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaa

SEQ ID NO: 140279 - DNA, 1339 bp, Homo sapiens
  Payload ID: 7520
  Gene Symbol: HNF4A
  Gene Name: hepatocyte nuclear factor 4, alpha
  Uniprot ID: P41235
  ENST ID: ENST00000457232
  CDS Start-End: 5-1333
ggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 140280 - DNA, 1603 bp, Homo sapiens
  Payload ID: 7520
  Gene Symbol: HNF4A
  Gene Name: hepatocyte nuclear factor 4, alpha
  Uniprot ID: P41235
  ENST ID: ENST00000443598
  CDS Start-End: 90-1343
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatga

SEQ ID NO: 140281 - DNA, 2302 bp, Homo sapiens
  Payload ID: 7520
  Gene Symbol: HNF4A
  Gene Name: hepatocyte nuclear factor 4, alpha
  Uniprot ID: P41235
  ENST ID: ENST00000415691
  CDS Start-End: 73-1467
gggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgag

SEQ ID NO: 140282 - DNA, 540 bp, Homo sapiens
  Payload ID: 7520
  Gene Symbol: HNF4A
  Gene Name: hepatocyte nuclear factor 4, alpha
  ENST ID: ENST00000609262
  CDS Start-End: 232-540
atggtcagcgtgaacgcgcccctcggggctccagtggagagttcttacggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaa

SEQ ID NO: 140283 - DNA, 1192 bp, Homo sapiens
  Payload ID: 7520
  Gene Symbol: HNF4A
  Gene Name: hepatocyte nuclear factor 4, alpha
  Uniprot ID: P41235
  ENST ID: ENST00000609795
  CDS Start-End: 5-1192
ggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaa

SEQ ID NO: 140284 - DNA, 4763 bp, Homo sapiens
  Payload ID: 7520
  Gene Symbol: HNF4A
  Gene Name: hepatocyte nuclear factor 4, alpha
  ENST ID: ENST00000619550
  CDS Start-End: 236-1585
ggccatggtcagcgtgaacgcgcccctcggggctccagtggagagttcttacggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttct

SEQ ID NO: 140285 - DNA, 1728 bp, Homo sapiens
  Payload ID: 7521
  Gene Symbol: HNF4G
  Gene Name: hepatocyte nuclear factor 4, gamma
  Uniprot ID: Q14541
  ENST ID: ENST00000354370
  CDS Start-End: 271-1497
ggagcctcggttcccctcgggcggctgaaggaggggctgagcctcaggacccctaggccaggccgtgttgaaagcagataccccgaggcctcgcccagcctgcgctggagggaagaaggcgctggaggagcaccagcgaaagcagccagtctgagatattgacactacagaaaaaactgacagcttactccttgtattgattctactcttctctacaaatatagactccgttccctaccacagccttatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggta

SEQ ID NO: 140286 - DNA, 4209 bp, Homo sapiens
  Payload ID: 7521
  Gene Symbol: HNF4G
  Gene Name: hepatocyte nuclear factor 4, gamma
  Uniprot ID: Q14541
  ENST ID: ENST00000396423
  CDS Start-End: 125-1462
ggattagcactcacagattgaaagcaaaacacatcaaaacactcatcacgcactctgggcttgtggtgccacttgtatgtgtgtttctaaatcaatgatgagggtatcagaaccaatactggacatggacatggcaaattacagtgaagttttggacccaacttacacaactttggagtttgaaactatgcagattctatataattcaagtgatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggtattttttccaactgcccctgcattgtgcctgaaccaattgaatcttatgtatgagtttcatttgttttattaatgttaatttaaatctgtaaataattgctttattgtgatgtgatacagaacaaagtgttcgtttttgactgaaaatagtagatcagaaatctcagtttaatataaaatgagctaagtttttaaaaataaattataaacttggagattagaaaaataaagcagttgctgtagaataggctgtatctttttcaagaagaatctcttatggacagtctgtggtaaagaagcaactctttgctttagagttaaatattcctatcttaagtttagaaaaatacaaaaaaccattccaaggatgactggatactttttgaaatctgactttctttgaagatgtatgttaagcaaaaacatgttgcttttatcagttaggatacagggtgaactgtaacaaagaaacccctaaaacagtgactaaatcaagagaggaatctatttctttctcctgaaacaatttagaaaatagttatccattgactagaaattagtacatgcccacagctggctcccacggtagccaggagaattatctataggtggaaagtctgtgtcagccaaagccatgtcactctgagagaactgattctgaggacaagttagccatctaccacccatgtcccttatttggtcctcacaataacactttaggagagatatcattatcgctgttttataaataagggaaactttagcttgagggtttaaggaacataaccaaagttcacaaacataacgagtgagagaaacacattcaagcccaggtctagttgactttaatgaatctttggtgtggaatgaaaaatgtgaacttcttactcatagtgtggtttttaaatatatgcagttgagtgatgattggatactattcatcatattgcctataatatatatttaccgataagcagtgagtgtaaaattgttgtagcttgaataagaaaccacttttgtagttttaaccagactttctcttaaaaacattagataaaataaaagattcaccggatggattctgatgaaaacgaaaacaaagtaaaatgactggcttagcagattctttgaaatgtagcagcccagggatgtaccaaatgtcgaattctagactgaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttaccttataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagttttttaactcttattttttgaaaatttactgtagcttctatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccctccaaaggccccacctcctaataccatcactctggggactaggtgtcagcatgtgaattttggaaaacacaaaaattcagaacatagcaaatacctttgaagtataaaagataaaattcatttttagtgaaccctgtaatttattcgtgtatatttactaaacagctgtatctttgaaattgttagtaatgattctgcttcaataactatggtcagggaatttataatattatatttttatatactgaactgccatagatgctggaaaaaaggaactgatgttttcagcatattttcaaaatattgataagggaagttattacttttatatagtattcaacttttttcaggtaatagaagtgaataatttattgtgaaataattcattttataaatgtataattatttttataaattttattgttggaaatcaaaaattagtagattttttaccatgttaaattatagtgagattaaagtattactaaactgtgatgctatgtttgtttcactaaactttctaaataaaaactgagaaaaaaaaaatcactgaaa

SEQ ID NO: 140287 - DNA, 2174 bp, Homo sapiens
  Payload ID: 7522
  Gene Symbol: HDGFL1
  Gene Name: hepatoma derived growth factor-like 1
  Uniprot ID: Q5TGJ6
  ENST ID: ENST00000510882
  CDS Start-End: 84-839
gcccagcagccgcccttactgcgcgcgcgcagacttcggcgtctacttccggtgtggcccaggcggggtccgcagaaccagctatgtcggcctacggcatgcccatgtacaagagcggggacctggtgtttgccaagttaaagggctatgcccactggccggcgaggatagagcacatgacccagcccaaccgctaccaggtgtttttcttcgggacccacgagacggccttcctgagtcccaaacgcctgttcccgtacaaggagtgcaaggagaagttcggcaagcccaacaagaggcgcggcttcagcgcggggctgtgggaaatcgagaacaaccccacggtccaggcctccgactgcccattagcctcagagaagggcagcggagacgggccttggccggagcccgaggccgcagagggcgacgaggacaagccgacccacgctggtggcggcggcgacgaattggggaagccggacgacgacaagcccactgaggaggagaaggggccgctgaagaggagcgcgggggacccgccggaggacgcccccaaacgacccaaggaggcagcccccgaccaagaggaggaggcggaggcggagagggcggcggaagcggagagggcggcggcggcggcggcggcgacggccgtcgacgaggagagtccgttcctcgtggcggtggagaacggcagcgcccctagcgagccgggcctggtctgcgagccgcctcagccagaggaggaggagctccgggaggaagaagtcgcggacgaggaggcctcccaggagtggcatgccgaggcaccgggcggcggagatcgcgacagcctgtagttaccagcgtttccagaagagcccctgccccgttcctgctgcggcctggccgttcttggggaatctgaccacggcgtgcaaactgggactgcctttccctctcctcagcccgtcctcctccaacccgcgctcctttgccctgccgggccccaggatggcaggccacctgactctcacctctgtgcccccacgcctctgtgatctgagtcagggcctcagttccctccctgggataaagtgaggccaccatcccagcttccggctccctcttctcccccctctacccgccaccccaccccaccccacccccgcccactcgttgcctgattccgtttccgacttggggttcaggcaggctgttttcacctctagacacccctctccacccctcctgcttccccaggcattatgaacctctgcttaggaatatgggtaggagtgaaaggcctggcagataaagagcagagggcacttgcagggcctgggatgagcagtcttcaagctgtggtagttagcgggcaggagagcgacatcttcctgagctcctgtccatgcctgccatacctgccagcttcagacatttagggaaaaggggcagcatgtggggaatgccccccgccttccacaaatccttttgctgacccaggaagttctgggagttgccgtttttcatcaaaacgtttgggggcttccaagttgtttgtgagatctgaaaacttaactttgcccaatatcctggttggggaccgtgagaaatatctgtcccatttagatctctggggccactgatgggatgccctgggaagatccttggctgccgctttctctccccacagcctcaaggccaccctaccgtcatatatatcactcaggcgtagaagaaaagacacatattttataaaatctttttaataaaaggaagttccaagaagaatttttaagaactacctctaggtgtgcctccacgctggccctagctttcccattgctgttccattgctgagacaaactggaaggctccctttctgtttgaagttttatgacttgtagtcaggctttgctgttcgtcacagtgtcattttccattcaggtaccatcacctggtcccatcaacaggtctagtatgtagctcactgataacagaggaagatgtgtctcctcccaccctcttcctaatggtcattatgcctttctccatctattgtctctttcaccccttcccctctcccttgggctctgatgaaaaattgttgactgcagtttcggaagtttgatctgagaaccaaccatagaatgtttcagttctaggaaataaaaccagttgattaaagcaaa

SEQ ID NO: 140288 - DNA, 2380 bp, Homo sapiens
  Payload ID: 7523
  Gene Symbol: HDGF
  Gene Name: hepatoma-derived growth factor
  Uniprot ID: P51858
  ENST ID: ENST00000357325
  CDS Start-End: 316-1038
gaggaggagtggggaccgggcggggggtggaggaagaggcctcgcgcagaggagggagcaattgaatttcaaacacaaacaactgcacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactata

SEQ ID NO: 140289 - DNA, 960 bp, Homo sapiens
  Payload ID: 7523
  Gene Symbol: HDGF
  Gene Name: hepatoma-derived growth factor
  Uniprot ID: P51858
  ENST ID: ENST00000368206
  CDS Start-End: 86-856
agaactgagctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctccttagcaaaggcggacgtagggctcaaatccccgacgtttccagggccaccccccatacgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccacccc

SEQ ID NO: 140290 - DNA, 2171 bp, Homo sapiens
  Payload ID: 7523
  Gene Symbol: HDGF
  Gene Name: hepatoma-derived growth factor
  Uniprot ID: P51858
  ENST ID: ENST00000368209
  CDS Start-End: 131-832
atacggtaagcacggcgaggtccagagaggaccccagtgcgcggagcggcacggcgcccactcctctcgccctcggcgcctagcacgctgccaagaaccgcgggtgcccagtaaatatttgtggattgagatggagcagagggcaggcggaaaccgtgtacagacgtccacacttaactgcgctggggccgcggtgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 140291 - DNA, 2073 bp, Homo sapiens
  Payload ID: 7523
  Gene Symbol: HDGF
  Gene Name: hepatoma-derived growth factor
  Uniprot ID: P51858
  ENST ID: ENST00000537739
  CDS Start-End: 170-892
gcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 140292 - DNA, 805 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000589486
  CDS Start-End: 443-805
ccagctgcatcctctgggggaccgcccgtgagcccctctttgcgggaggggtccccaggaaaggtcctgggagtccatagacgctgagcttggccccaccccctggttgcttcagagggccggatctggctttgctcagatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgag

SEQ ID NO: 140293 - DNA, 1349 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000592417
  CDS Start-End: 1-462
aaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgagtgagtgtcccgggccgtggggtttggactcctgagcggcagcggtgtgacgcgcaccctgggtccgagccgctcctcctgtgccagtccctctgggatgggtcccagggatgtcgtccttactcgggcctcccaccttcacagctgaccccagggccccgctggctggcacttccggcggcccctacagagaggcagctccagggctttgagctgcctgcccctggcctcctgggaaggtggcttcttgccgagcctccagggtggcccaggtaggtaggccccgagcacgggcacccggctatctgacggtgcctgtgcccatcactgtgggctgctgtctggtacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaag

SEQ ID NO: 140294 - DNA, 740 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000592691
  CDS Start-End: 667-740
accgcccgtgagcccctctttgcgggaggggtccccaggaaaggtcctgggagtccatagacgctgagcttggccccaccccctggttgcttcagagggccggatctggctttgctcaggtggagcacctgccctggggccagctccgtccctggggtagggggagagctctctgggtggggcacagctttgcagtgaagggtacacagaagaatgcagcttcccatcgggaaggggctgctgcttcctgggttgaaggctcccctcctcccagcgtgatttgccccaagtaacttggctgatttctcggtgatttcctgggtcagtgggtaaagccaccccctcactggcctctcactgcagatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtag

SEQ ID NO: 140295 - DNA, 870 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000587016
  CDS Start-End: 1-527
caagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaac

SEQ ID NO: 140296 - DNA, 648 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000601353
  CDS Start-End: 44-337
ccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgcagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccag

SEQ ID NO: 140297 - DNA, 3100 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000615225
  CDS Start-End: 1-1420
aacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagctggagtgcaatggcgtgatctcagctcactgcaacctccgcctcccgggttcaagcgattctcctgcctcagccctcccgagtagctgggattacaggcacccgccaccacgcctggctaatttttgttgctttagtagacacggggtttcatcatgttggccaggctggtctcgatctcctgaccccgtgatctgcccgcctcagcctcccaaagtgctgggattacaagtgtgagccaccgtgcctggctgcagcccacgtttttgtttttgtttttgtttttttttgagacagagtcttgggcttgctctgtggcccaggctggagtgcagtggcgccatctcagctcactgcaacctctgcctcctgggttcaagcgattttcctagctcagcctccaaagtagctgggactacaggtgtgtgccaccacacccggctaattttttgtatttttagtagagacggggcttcaccgtgttggccaggatggtctctatctcctaaactcatgatccccccgcctcggcctcccaaagtgctgggattacaggcgtgagccaccgtgcttggtcccccagcccactttctaaatggccttgagtgggcaaacctgcccatgagaattcggcaggccggtatggcagtggcggggtacagagcagcacatggcaccgagcctcagcaatgggcctctctcctgcacgcgtgtcacccttgagggccttttcctagctcgctgactctggtagacaaagccagcccttggccatgtgaacgaggaaaagaatcctgggatttcatgagaactcgggaaaaggcttgtatctttgggcagctcgagcctgtggctgccctggtctgccctaggcctaggctgtggcagggcctccccgcctcccgtttcccggcttagctcccagggcctcccaaaggtttcctttgcagtgggtttgggtccaccccttcaggcgccagcccctcagtggcagagtgccggtgacggggcccgactgaggggagcacttctccacaggcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatg

SEQ ID NO: 140298 - DNA, 320 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000619255
  CDS Start-End: 1-207
gaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgactgaccccagggccccgctggctggcacttccggcggcccctacagagaggcagctccagggctttgagctgcctgcccctggcctcctgggaaggtggcttcttgccgagcctcca

SEQ ID NO: 140299 - DNA, 239 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000614903
  CDS Start-End: 1-216
gcagaaagtgaacaaggctgggatggagaaggagaaggccgaggagaagctggccggggaggagctggccggggaggaggccccccaggagaaggcggaggacaagcccagcaccgcagcgtacgggagggtcccgacctggacaggcctgggagcgaccggcaggagcgcgagagggcacggggggactcggaggccctggacgaggagagctgagccgcgggcagccaggcccagcc

SEQ ID NO: 140300 - DNA, 2281 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  Uniprot ID: Q7Z4V5
  ENST ID: ENST00000616600
  CDS Start-End: 65-2080
ccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaa

SEQ ID NO: 140301 - DNA, 2255 bp, Homo sapiens
  Payload ID: 7524
  Gene Symbol:
  Gene Name: Hepatoma-derived growth factor-related protein 2  [Source:UniProtKB/Swiss-Prot
  Acc:Q7Z4V5]
  ENST ID: ENST00000621835
  CDS Start-End: 46-2058
cgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaa

SEQ ID NO: 140302 - DNA, 12733 bp, Homo sapiens
  Payload ID: 7525
  Gene Symbol:
  Gene Name: Hepatoma-derived growth factor-related protein 3  [Source:UniProtKB/Swiss-Prot
  Acc:Q9Y3E1]
  Uniprot ID: Q9Y3E1
  ENST ID: ENST00000299633
  CDS Start-End: 605-1216
gcccaccgcccgcccgccagccgagaagccgggctggcgcgctcggtttctccgcgaaagccggccgtgtacctaggaattaaccggcccgcgcgggagggaaggggaggggagcgggaagcgggaagcggggcgggggggggatgctgagcgcgcgcgagaacaataataagatcgtgtttgcggtcgctgcccgagaaggaattcggagcagacgcgaggcccggcgctcgcgccgcgcccgggagcccgggagggagaccggcagcggcggcatgaggcaggcgacgcggcgctggtgagcagcgcgcgcggcggcggcggcggcggcggcggggaccttggcgcggccggacgcgggcgagcgccgaacggccgggggctcccctcccccgctgccgggccgtgatttgccgggcctgctgcgccccccgcccaccccttgcctcagccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagcaagctgacaatagaatcaagtgcaggtgagggtttttctttttctttctttttttttttttaaacactctctgggttttagattatttgaaaacactgtaggggatgatggggagatgactacatgatttgcttacacttacatatttaccagcccagtggaccctagattttgtaatttgatattatccatgcattgatttgtatcccattttcttttggttttcttgatgagagctaataaaaacatgagaaaatgtgagcagacctaaaagcctagggccgttaataatgatgatggtgatgatggcagctaagggtatgaaagcaccagtccatttatcattccagggcacagtgaggaggtggctgtttgtatttttggtgtgtttctttcatttagtgaatactgattttctctagtatactcaacatacaatcccaaacatgaaaagttcataaaaagatagtagggatgtcgatctaatacttcttccttaaaaggtcctttttaattttgaatatttgaatgtattttttaattaatgaaatttaattcatcaaaagacctcttcattgctcacactgaaacataaggggaatgtagatggcattttgaattggaatatacaactcacaaattttctttaaaagcgttttatgtgtatatatgaaatgtttcaaatttaataagatttgtctttataagaggccaaaaataattttattaaaaatatacacagaaatacaatagaaatatttccagccaccaataaaacaaatgttcattaaggatagagataaagttactgatccctatttagctgtttaaattcacacaaaaaaatttagtaaaagtaattttcttgaaacagcagcaaataataaactttccttgggaaaacatttttcaaacaacatttaaaaatattctgatgatttgccttttatattgagtttaataatgaagcatattcatcttatttgcaaaagttactcctccagtctgcattcactgttttgaattttttaatatgcacaggccatattctcttttgaatagtttcatttcatgctcactactgttggcactaaattgtaattttttacacttataattattttatatgtcaaacaatattgagatggatgatcaagtttattcacaaatgattttgaatatatttctttaaacaaactgtttctcaagaatttccattttccttcaaaaaaaatttacacaataccatatagctcacacatacagtgcagagcaagaatgtacatattcttaagtactcacgtatgagaagagagtgaaatgggacaaaatatcagtaccagtataacaaaagttagtaatttagaaaggaggaacatgaagtaatatttttattccactttttcttctgcctttgtttttatgaagaactctggtttgtagatacaacgataggccaagagctgaggaagaactccatatgctatgtttaatgctaaaaaaaggatttttgcttcttcagggactctgtagacataagcagttctagcatgaagagatgcaccaatgtgagaaaactgagcctgttgcatttaaaaaaaaaaaattgagtaagcatgaaacgtgttcagttggatgcatgatgagttctgaatggttcattcaggctacgtttctgtgccctcaaaaccagtctcacctgcaggcaaaataccttcaaacaatccagagtctttaatgtcagagtctttcattaaatttagtccttgattaaatttagggccattcttgatatgactgttcaaataaagtagatattatttagtgtagttttatcatgccagttgtgttttttaaccatcaagtgccccttaccgaacattagtggctcaatctaatagaaaaatctgaataaaatctcaaatttttttctgatttgcgttctggagatcctgcatacagactcagttgtggttcacaaattgcgttccaataaaaatgaagaaagcgcagagttttaaaaaacaaatatttttagcataaactattgaaagggaagcactggggggacctcagcttcatttatcagtctttcatctactccttgcagcaagagctcataccctttccctatgtgttttttgtttattcatttattcatgtatttgttttttctgcagcttttaaaatattaagggttgtttgtaagataaggttgttaccaacttgggtggaggtaggagtacggttgctctttgtaaaatggcaaatgtacatgcaggcaacctttttaaatcaaattataatttatttagaagtacgacatgtcagcattatccgcatttgcaaaatggcctccctctctacttatatacttattcagaaaacacattcagaatgtgccaattggtcttttttgatatttttcgcaagcacagaggaaaaccgtattggaaagggtaaaacagaccacagcaggattaaaagctcctgtcagaaaatttcctcagaaggcttgtatcattacaaaatgtacccctggagtctgcattttcatatcttgctgaaattcaagatacacatgaataaaggattgggaatctaaatgtaataagtagtaaattatcagttcatcaggatcaaagagacaaaagactgcactatagagaaggcatagaagtaacaagaatgaagaactagataatttgctttaaatacatataagttattttacatttcttccatatgaaaccaatttattctgctgagtgatttcacagataaaggtgttacttacttgacttcaccatgacaagaaaaggacaagtttttttaagcagcatctttatgaattttttatcagtggcagatattttaatgggctgcatttttacaaattcctgatatattctggagacctgtggtacatttttgctactctggagatataaattaaattagcatgatgtattgccaaggaccagcacgtggattgtctacattgtgatccatgaggcactgagaggactcggccctcagatacaactcccctgggtagatgcccaggcagaacccagcaaatgtatatgcatctctgggctctgaggacaaaatgccttgagagtaaagggcactttcagggctgccctgaggaggtgctttctggacattctaggaactctgagcaggagcatggctcccatactgtttttccttagggcctgttttgaataatagtgtttttctgaatatataaccaagcattttctctggactggaagccacatttgatccctggttctcagaaatctgggtttggtggttctgtctttatagatacttgtacacatcacaaaatcaccaaatttggggaaatgccaaccatactttgagagaataaatatgagcagttgtgcctacttgcataggggagcctgtgtaaaaagtcagtgattccgtaggctcttttcctgcactaaccagtgcagttaatacctcactttcatgaacagcaaactcatggcaacattaagtgaatcatggccgggcgcagtggctcacgcctgtaatcccagtactttgggaggccaaggcgggtggatcacctgaggtcaggagttcaagacgagcctggccaacatagtgaaaccccatctctactaaaaaatacaaaaaattagccgggcgtggtggcagacgcctgtaatctcagctgctcgggaggctgaggcaggagaattgcttgaacccggggagtggaggttgcagtgagccaagattgtgccactgcactccagcctgggtgacagagtgagactctgtctttaaaaaaaaaaaaagattcatgtccttagattagattgtaagcccactgggcaggtactgtgtctaatgttttgtgtggcacctgtcacattgttagagctcaataaacgttcaacaacaatggacttgtgactgtcaaaatacaaaaagggtctacaaagcatttctctagttttgtatgtattttagtaggcctctttattcagaattattaaacaaggcacaaaaattttaacattcataatcaaaagaggcatttgtatgtgagagaagaactctaaggccagtggtgtgcagctcccagtactgctcatagtcctaatggatgtacttatggtggccacacttccagctgagtgagcacctgaccatagctttctcctaaggcataggatgttaagtgttcagggttctgaagttcagaaaaacagtctcacctgaggaggtttctcttcccaagcacatagctaataaagggctgcaggttttctcctgggtgatgttcccagcagcacaaggcctctcatggcaggacctgaagagctcagcctgagcctgtgctggggtcaggtggctcagtgaactcaatgctgctgaattaacaggaggcccaggattacagatatgagttgttgatcctagaaatttctccagaatttagcaatgtgaggttgagtccctaataatttttcttccacttcattctaaatcattttcaccttacagaaataattaagagatatactctgatttttttttaagaatggatgattggaatggcaaatgagacaataaggtgaacaaaggttaaattttaagagctgttttcttacatgtatagagacaatctgtaaaggataactaaaaaagttaatcgtggttccacaaggaggaactgaaagagtgttatatgtccatgtgaatgttataggcagaaaacttaggtgaccattgggatgatagccagggtcttttgctaatacagtataaatagctaatctagaactgtgttatcttttcttagagttttctgagcaacatagttcattggttcagaacactgactttggaactagacatccagagtcaaatcacagctccaccacaaaccagccgtatggcctcgggtgaggtgtggaacccacctcataggttgttatgagggttcagtgaggtgatgtttgtgacatgcttagacagtgtcaagcacttggggctattctgtagacacaagtacaaaactgaaatacccattcatgatctggtgctcgactgtagaaaatctgggccctttgtttttagattctcttgaccttttgacctttttactgtgagtgtctccatgaaaggataagtacataaaagatgttaaatcagtataatttaatactaaataaagatgtttagcaatgaatcacaccagaagcaaatgaagaaaacaagatttgcattagtatcccaactatccgtgttcttcctaaactgttactttcagatttttcttaacgtctccatgagggaaaaaccgtatgaaatttacttccaggctgagcgtggtggctcatacctataatcccagcactttgggatgccaaggcgggagggtcacttgagtccaggagtttgagaccagcctgggcaacatagcaagaccctgtctcaagttaaaaaaaaaatgataaatttacttcagtaaactcttcacaaccaaattattcacacgtaagtttccatatctctttgtgagaaaaagacatgacatagcacctacatagccagggagttagagagtctgagggcagcacctgactgaagtaactgaacctccttcgctggctgtgggatggcaggctccttaccaagcccatggtgagtctgtcccaaagctttcacccagtttctttgttttcttggtaattatatacaatacacttaatttaattagtttgtcttcaggttaatcttcggaacaacataaggcatatctccaaattcttactgggaatcttctaccagtaatagtagcaacaaagggttacatagctgttatgtgccagacactgttttaagccctttacatgtattacctcatccaaccctaacagcaattccatgagaaagctactgttattatcctcactttacagaagaggaaactgaggatcagagaggtaaagtagccaaggtcattgtgctcatcagcaacaggctagaatctgaaccagttcacctccagagcttatgttcctaactatatgaactctactggctttggctttttttcattttcattgatattttagcagagaaaatgcttcaattgataggaaatgctaataagtggatctaagcagcctataatgcctttcagattacacttgcagctttaatcctatggttagcattttatatgaaaagatacctgggttatgagtaagtccccagtggaactctttggtctaaaatgtgtcctggtttcattttattcaatcttcttttactctttccttgatcttttgatttctgaaggcagcagatttggcagactcctacatggtctgaaatcaaggccccaataactactcactcttttttctttcttttttttgagacagtcttgctctgtcacccaggctgcagtgtagtgggcgtgatcttggcacactgcagcctctgcctcccaggttcaagcgattctcctgcctcagcctcccaagtagctgggattatagatgcccaccaccacacccagctaattttttgtatttttagtagagacggggtttcgtcatgttggccaggctggtctcaaactcctgacctcaggtgatccacctgcctggtcctcccaaagtgctagggttacatgtgtgagccactgcgcctggccactactcaatatttcttccattggcctatactgatctagaacttttcaaaggtggtttttttttcccttactaagttgcatagattcttgagagtttactagatgtttcagtaaaagtaagttttagtaaagttagtgggatcatgaatgcataaggtttctaaataagaatggcaattttagcaagcaaagatgctgattaaagttacagaaaaatgcctatttttgttttgttttgtttttttgtggtggtgggagagacagggtctctctctgtcacctgggctggagagtgcagtgacacagtctcggctcactgcaacctctgcctcctggttcaagtgatcctcccacctcagccttcctagtagctgggactgcaggcatatgccatcacgccagcctaatttttgtattttttgtagagatggggttttaccatgttgcccaggctggtttcaaactcctgacttcaagcagtccacccacctcgggctcccaaagtgctgggattacaggtgtgagccaccgtgccttgctggagagtgctttctgtgatgaatgtgtcagatactcccataagatgagactccatttcataagcgagtatttgctaagtacaaaacaaataacgtaattcagtattctggtcatatctattgttttgttgcggcatggcttctaacttttccttagcctacacactataagtgggtagatattaaagctcagccaagagctgtgggaatcagacccataattctttactcagtctgtcttcacctgctgggctgggagaaacatccttctgacatttacaggatctggtccttagccttaggctctggatctgggcattcaccatcaagagaggggcttcaggctgccttatcaactgggcagtgatggataagccccaggatgcctgacgtctgacatgaatgaggtaatgcccctgcggctgccagctgctctgtagtccacactgcccttctcagaaccacttggctggagtaataagtgcccacctgcaagcttagcttcaccaacagattagggtttgtcttattgctacaggcttaccacacccattttcctctaagctatgaccttcctaagcttcctgactgttgaccctggccatgtgactaggcttttgcctaggttttcctgctgtttccatttgtctcctgagacttgaccaggtccaacatctggtctctttaaccagcctgctggctgatgacacttagcattcctgcatcagggactggtaccaggccgaccaggcacatggcaggcagaggaggcctgattgtgcaggcaaagcacaattgacacaggtaataggtgtcaaactgaacagctgtcaaactgaacagtctaatcctctaaagaaagggctggcaagagtgaagtgggtatgcggccatctgttctgaaggatacaggagaataaggcagaggaaccaggccaaaaaaaaaggcaaggcttactctgccctcagacctgctgcatatgcccacacctcagtgtttccctgggttattccctggagaggctcagcctaataaagccccacttggccctcagagtccaactcggaatgtcactgccttccacccacaaggttctccagcacctcgtactacatacagtcttttgtgctgtaggactctgtgccatagttcattgtttgcatggggtgggtgagataacacaatggagaagaatatgagctttggagtcagacaggatttcataaacctattctgccatttaataactgtaatcttaggcaaataatttcaggtggactgagcctcagcctcctcatctttaaattggggtttttttcccagagctattacaaaagatattattatgtgtccattgtgctgtttattctgaggcaggcaggaagaccacagtcaccagcctcccctcagttgacctggtgccaggcctggaccttgaaaatatcccacatgatctttgcataaaaaagaattaaaattttaattgtgttaagctactctgagtatttgttacagcagcagagcacatagcctatccttagacaaataggtaagtaaaacttttaacgtggtttgcctggcatgaagtaaggtaatgagagctcagactagtgtaggggcagcggagctggaaaaaaaaaatgggttggagaatcactggagtaaaactaactggacctggttgggtgtggtggctcacacctgtaatcctaccactttgggaggctgaggcaggaggattacttgaagcaggcatttgagaataagctgggcaacaaaataagatcccatctctttaaaaaatttaaaaattagctgtgtgcggtggtgtatgtctgtagtcccagctactctggagacagaggcaggaggattgcttgagcctaggagtccgaggctgcggtgagctatgactgtgccatcacactccagcctgggagatggagcaagaccctgtctctttaaaagaaaaaaaaaaggacttagtggtggtctagatgtagaggatgaggagtgtaaataattactccaagtttctggcttgagttgctggatgcaattggactatttaaacagataatgaaaaaatggaagagaggttgtggggaggatcaggtcctattttatatattaaatctgaggtgctagtgaggcatgcaagtaaaaagactgagtttggaatgaaatacaggagtctgggaacggtgtgggccgaaggtagaaaactggaagttatcagcttatagttggtattgaaagatacaaagataaagacctaaaatacagaaataaaccccaaggactgaggaatcaggtatttagaggtctgcaaaggaaaaacaaccagcaaagagcaataaatgttagttctcttccttcttaagcccctcaaggaaaggacaggaaccattacttctggatgctacatcaactttttcgatactactatgctaattttataattaagaattacctcaaactgaaaggatttaatgcattgaccccttaaatactatatttttcaaccgtgtgaattctagtatgtcttacgatcatgattattataccatgcatataattgactgtacaagcctacagtttctagatgaacctcattcttataactgcttgaaaagaacaagatgaagctaatgtttttaaatgataagttcatttgttttatttctagtaagaaaaattaattttcttccttgttcagaagattgatttgttttgctaattatcttgtaaaaatgtgctttatgttatgtgtgaagttctccatagataatttcattttcagttaaacgcagtaagcattcactgaacacctactctaggccaaatatttggcaaggtgccagcggaaaaggaatgaaatgacaggcccagaacattttttaaaccagtttccctggttctgtatagcatagcgtagtggaattctgaagtcttaaatttggatggacattttgaaggtgacagctctcaatccttttttagtagccatggtattcagagattgtgaaacagtccaataaaacaacaatgccaca

SEQ ID NO: 140303 - DNA, 3397 bp, Homo sapiens
  Payload ID: 7525
  Gene Symbol:
  Gene Name: Hepatoma-derived growth factor-related protein 3  [Source:UniProtKB/Swiss-Prot
  Acc:Q9Y3E1]
  ENST ID: ENST00000568294
  CDS Start-End: 1-426
tttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggaagatgctgtggacaattatcgagatagactaacagaataccccttctacacacccagctggacctccacctgtgttcgcagctctccccatccctgcctaagtactctcatcaagggaacactcatcacaggagtggagaatgatggtcactgccggctcagtcacagaagattctagcaggccaactccacccatcctccactcccctacaagtggctgcccagaatcaaacccacatcccacatgggcagtgggagcaaagccagtaactgagtggccaaggaagcatagaagtgaccactaagtttaagacaatgattcaggctgggcatggtggctcaagtctgtaatcccagcactttgggaggctgaagcaggcagatcacctgaggtcaggagttcaagaccagcctggccaacatattgaaaccccgtctctactaaaaatacaaaaattttctgggtgtggtggtgcacgcctgtaatcccagctactccagaggctgagacaagtgaattgcttgaacccaggaggcggaggttgcagtgagccgagatcacaccactgcactccagcctgggcgacagaacaagactctgtctcaaaaaaaaaaaaagacaatgacttgacgaagtgattcatctcaatgattcccaagcaggccacctcacagcgtgtccagtgtggttaccctattccacatggcgtatcctagagacagacaggtggctgatgtgcaagtgacaatggctttcagaaaaaagactagtgatgttaaaaatgaatacaagagggtataattgaatatgacagaaggaaagctatacctgtcagagaatcttaccagagttgtgagcatctcctaaatgggcttaaaactactagcacaaataactaagaaataatactttttaaacagcaggtgatcaaatttagtgcatgttagtttgtcaaagctgcattttcaagttgtaacagattggtgccttagactatgggatggacatggacagaagaaaaatctgatggtgaatataagaaaagctgtgaaaaaagaaatggagaggagtgtggggatggttaattcacagagaagggaagccggccttgcctggagtcagcagccaggagtccagcattcacattctccccagaaggaacaaaaggccacatgtgccctgttttgcagatgtgccttccccacgcctccatgggggcctttggcccagttctcattggcagtgtcacttcctgatactcattttccagaagcctcccaggtgattagccatcatatgtctccaagaaaggaagtgttcggcacataatctgccaatgattgctgatgacaacacaagtgtcagacactgtgttagcaatgacaaggacatggtctctgccttctagtacgtgaggagtctggccttgagcctcaccctgaggctgcagtgtactcaaagttgtaacagaccaggacagagggctgagggtacaggagaaagggtgcccagccttgaagagtcaggagagacatcagtacagttaatacaggctccatggagtggggaggaacaggagggacagacagcagcaggaaactcatctggaaaggtgtgcaagggtcagagcacaggctagtggagagagccaggaaaaggcatgtgggccttgaaagcagacggacccagctcatctaatgactggctgtaaaaccttaggcaaattacatcatttctgaagcttcagagcttcttatatgtggattgggagaaactagttactcacaattcttccttcccaccccacctttcccaaggcccactgtaggcagagaatgctccctatgctgttgctgatgggcttggccctatgcctcatctcagccattggaatatgggtgggagtaagatggggcagctccaagccaaggccttaagagccaccactttcttccttctagccccactgtgcctctgtatctgccatgagaagggcatgcctgggagctgctggtccaagaacaaggagtcagagaacagccctgaaatcaacccacagcctgatgcagagtggccccaacccacagacctgtgagcaagaaaaataaatgtttgttgctgtaggacttggggtgcatttgatatgcagcattactgaagcagaaactacagaacaaaatgcccagcaaggtacctggcacaggaagtgctcaaaggccggtagcagcttggctggggcagcatgcatgatggaagggcatgggctttaggggtcaacagccacacgacctttgccacatttcttagcatctccaagccagctgcttcactttcaagtggagggatggtgaggattaggtgaaagcctgctgctaaagtgctcagggtcatacaaggtgcactataggtgcttgtctctatggcaggttccattattttcctcttcatgcatatgtgcagacccagacaccacacagttaagttctgcactaagtgggggggactgctagtagcaggctgaagacaggaagcccaggaaggagctagcatgagagtcgaggtcagaggtcagaggtcaaagcatgctggggttggcagggtgccctgcctggcctggcagtaactctccaccgggatgccacctgggagagggtggagtccactgcctgagaggcaatagccagaggcgagggccagattgtcctgaaacacccctacacttgcagccactgttaccaaagggctcagagtattcacaaccaaggaggaatatgtgactgaggctgaaagtattgtgttattaatcagatacaaaagatttccctttgtggagacgtaccatagaacagtgggtcccggggtggttttcttttgacgaggacacgagccagcagtgctaccaggaacaggatgagggcagcaacccctacaatagtccaggaactgcaacgaccagaacagggaggtggtcactatcaaaataaacacattggtgcctggaa

SEQ ID NO: 140304 - DNA, 934 bp, Homo sapiens
  Payload ID: 7525
  Gene Symbol:
  Gene Name: Hepatoma-derived growth factor-related protein 3  [Source:UniProtKB/Swiss-Prot
  Acc:Q9Y3E1]
  ENST ID: ENST00000563790
  CDS Start-End: 128-262
ggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattggaacttttggcagaaagtcaaaactgtcttcatatctgtatccttagaaagagattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattat

SEQ ID NO: 140305 - DNA, 448 bp, Homo sapiens
  Payload ID: 7525
  Gene Symbol:
  Gene Name: Hepatoma-derived growth factor-related protein 3  [Source:UniProtKB/Swiss-Prot
  Acc:Q9Y3E1]
  ENST ID: ENST00000563404
  CDS Start-End: 115-249
gtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattggaacttttggcagaaagtcaaaactgtcttcatatctgtatccttagaaagaggaagacttctgtgaaaatgtgacacttcagcagagttggatgttctgaggaaaaagtaggaatgagctcagcataatcaaggaaaagcaagaaggcaaatgaggcgcagagtgagcgagctaggacctgggggagaaggacagaagatgaattcagattgatgaactcccagagggcgctgtgaagcctccag

SEQ ID NO: 140306 - DNA, 558 bp, Homo sapiens
  Payload ID: 7526
  Gene Symbol: HAMP
  Gene Name: hepcidin antimicrobial peptide
  Uniprot ID: P81172
  ENST ID: ENST00000222304
  CDS Start-End: 233-487
aacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttgga

SEQ ID NO: 140307 - DNA, 652 bp, Homo sapiens
  Payload ID: 7526
  Gene Symbol: HAMP
  Gene Name: hepcidin antimicrobial peptide
  Uniprot ID: P81172
  ENST ID: ENST00000598398
  CDS Start-End: 297-551
gagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaa

SEQ ID NO: 140308 - DNA, 4228 bp, Homo sapiens
  Payload ID: 7527
  Gene Symbol: HEPH
  Gene Name: hephaestin
  Uniprot ID: Q9BQS7
  ENST ID: ENST00000336279
  CDS Start-End: 839-3514
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactg

SEQ ID NO: 140309 - DNA, 4854 bp, Homo sapiens
  Payload ID: 7527
  Gene Symbol: HEPH
  Gene Name: hephaestin
  Uniprot ID: Q9BQS7
  ENST ID: ENST00000343002
  CDS Start-End: 665-4141
tttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattctagtaaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgctacaccattgaaaaaactggatccagatctctcttctgaaggaactagtaatacatgattagcagcacgggtgactttttaactatgcccttcaaaatccaatcattgaaaacttattgaattaaaaggaatcaggtaagttaaagaaactgggctaaatgggttttgctttctcagtcactcaacctggctcttgcctcttcagttttctggacacgtagaaagcccctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacact

SEQ ID NO: 140310 - DNA, 569 bp, Homo sapiens
  Payload ID: 7527
  Gene Symbol: HEPH
  Gene Name: hephaestin
  ENST ID: ENST00000429547
  CDS Start-End: 178-369
ctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatatatgtgaaaatgtgaaaaaagaaagtaagccttagaatcaaggaattaatggtaataattctcacttatgtaatactctgtgacacagaccatactagaaatttacatactttgtctcaactctcacaaaaactctagaagagtggcttccagcttcttaaagtctgacaagaaccggatagggggaacctacaagaagaccatctataaagaat

SEQ ID NO: 140311 - DNA, 838 bp, Homo sapiens
  Payload ID: 7527
  Gene Symbol: HEPH
  Gene Name: hephaestin
  ENST ID: ENST00000458621
  CDS Start-End: 215-838
aaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaaga

SEQ ID NO: 140312 - DNA, 2459 bp, Homo sapiens
  Payload ID: 7527
  Gene Symbol: HEPH
  Gene Name: hephaestin
  ENST ID: ENST00000425114
  CDS Start-End: 26-2459
cctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatgatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctg

SEQ ID NO: 140313 - DNA, 4310 bp, Homo sapiens
  Payload ID: 7527
  Gene Symbol: HEPH
  Gene Name: hephaestin
  ENST ID: ENST00000441993
  CDS Start-End: 117-3599
ggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaaca

SEQ ID NO: 140314 - DNA, 3694 bp, Homo sapiens
  Payload ID: 7527
  Gene Symbol: HEPH
  Gene Name: hephaestin
  ENST ID: ENST00000419594
  CDS Start-End: 111-3020
gtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttag

SEQ ID NO: 140315 - DNA, 6013 bp, Homo sapiens
  Payload ID: 7527
  Gene Symbol: HEPH
  Gene Name: hephaestin
  Uniprot ID: Q9BQS7
  ENST ID: ENST00000519389
  CDS Start-End: 180-3818
aattctaggggctgccatggcttggctaagcttcccttgaccactgagcatttctaagggagttgaggctggtggctcctccttccttcctactggtgcttccacctgccttggtctgagttgcagtccatggggcagcgcctaagtgtctgagcacacttaagaatctctagtggtttatgacccagactttgccctaccacctcagtcttctgaatgttctcttccctggaccctgctccagacactttaaattcagaagaggaaaatgtgcccagcctgcctggagaaaagtgtctgctcctagccaagatctcctcatcacaaaagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaagactgaatttggtgatttttgacagtctctgtggcttctgtcactgtgattgaaacagaaaatacttagggggtgagtgagtatagtatgtatttgtctagcctttgtagaacctacaagtttttgttttagagatgaggaagctgttccagaggaagcatcaaagagtgctgggtaccaccctagaaaaggagctgtcgcataaatgacaaaaattttctgagtgtcaagaaaatttgccagagggaaatagaagtctgagacgagactcaaacctgtccagtgggccaggggaagtaggaccatatcttatggggcctttttggcagtggtggtgtgaaaggtctagttgcaactttgggggcttccttataggatggagtcattctttctggtattttacagcaatattcctttgttacatgcaaatttgagccaaatattggttagagagcacagataagtgataaattttagattgggtaagatggcccaccccactgcaatatccataatattgtaccacatggcaagtggagaacagaagaggtatcaaggagagaaaagatgataactatgtactgttttacactttaaaaagcattttaattcttgattgcgtttggattacctcagggcaagtcattttacatttgagtaatgttatccatttatacatttgagtgaacaaaagcttatggacattaagtaacttcatccaagatccctcaggtagaagttgagcagggattcatgtattcatctgtttgactccaaatacctatttcatcctcatatatcatggaaacatccactaatctccatccaccttacccatattgattccaacttttctgtctgtccagcaatctgtctgtctaggtagcaatctcttgaagataaaatgtagaaactcacagagctggtgttcagttacgatataagtttggaggagaaaacacaatccagaagctatgattcctcttgtttttccatggtcaatgggtttctggagagctttactgagaatctcagaaataaagtgtgggtggaagggggatttagatggctagttatccaagagttagtgtttaggccattgcagaatcaatgatttaacagcagcagaactgttttggcctgcagttaacatgaatgttaatgaagaccaagtacatgctaggaattccagtcaattaatggttataatttacatgcaactaggaggttcttagcttggtctcagttataactctaagagactaggagaggtagatgagatggaatgcatttcttcttattttgtaatcctgctccaggtcaaggaatagaaactcagagcccatgtatttaagaaagaaatgtatttttgtggtaagtttgctccaagtagggatacaagtatctatttttgacaatcaagtgacattgccatctattcagttgctcaagctggaaattatcagtgtcaacacatc

SEQ ID NO: 140316 - DNA, 5345 bp, Homo sapiens
  Payload ID: 7528
  Gene Symbol: HEPHL1
  Gene Name: hephaestin-like 1
  Uniprot ID: Q6MZM0
  ENST ID: ENST00000315765
  CDS Start-End: 9-3488
atccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaaacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatgccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcagtgactctgatctctacttcacacaaggggacaacagaataggaggaaaatactggaaggttcggtatactgaatttgttgatgcaacttttactaaaagaaagagactctctgctgaagaagcccatcttggaattcttggcccagtcatcaaggcagaggtgggtgataccctgttagtgacctttgccaacaaagccgacaaggtctatagcattttaccccatggtgtgatctatgacaaggcatctgatgcagccccaaacctagatggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatgctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaagacatggagatatatttatgaaccgcactgaaaattggattggctctcagtacaagaaggtggtttacagggaatatacggatggagaatttgtggagatcaaagcccgaccaccacgagaggagcacttagaactcctgggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggagaagtaaaaacttatagatggaatatccctaaaagatccggtccagggccttctgatcccaattgtattccatgggtttactattcaacagtaaactttgtgaaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatgccattaatggaaagatttttgggaatctccatggcctcataatgaacgaagatacaatgacaaactggtatttgttagggataggaagtgaagtggacatacataccatccattatcatgctgagagctttcttttcaaaatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacatagacaacaggattccttactccaccacatctcctggagtggcatctcacccagccacggtgccatctaacgaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtg

SEQ ID NO: 140317 - DNA, 2363 bp, Homo sapiens
  Payload ID: 7529
  Gene Symbol: HPN
  Gene Name: hepsin
  Uniprot ID: P05981
  ENST ID: ENST00000262626
  CDS Start-End: 826-2079
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 140318 - DNA, 1783 bp, Homo sapiens
  Payload ID: 7529
  Gene Symbol: HPN
  Gene Name: hepsin
  Uniprot ID: P05981
  ENST ID: ENST00000392226
  CDS Start-End: 246-1499
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 140319 - DNA, 1212 bp, Homo sapiens
  Payload ID: 7529
  Gene Symbol: HPN
  Gene Name: hepsin
  ENST ID: ENST00000597419
  CDS Start-End: 162-941
tccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggaggtgcaggtcagctctgcggacgctcggctcatggtctttgacaagacggaagggacgtggcggctgctgtgctcctcgcgctccaacgccagggtagccggactcagctgcgaggagatgggcttcctcaggcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaa

SEQ ID NO: 140320 - DNA, 564 bp, Homo sapiens
  Payload ID: 7529
  Gene Symbol: HPN
  Gene Name: hepsin
  ENST ID: ENST00000600390
  CDS Start-End: 324-564
acgccaccgcctctgcctccaggccgcccgctgctgcggggccaccatgctcctgcccaggcctggagactgacccgaccccggcactacctcgaggctccgcccccacctgctggaccccaggcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgct

SEQ ID NO: 140321 - DNA, 3703 bp, Homo sapiens
  Payload ID: 7530
  Gene Symbol: HPS1
  Gene Name: Hermansky-Pudlak syndrome 1
  Uniprot ID: Q92902
  ENST ID: ENST00000325103
  CDS Start-End: 235-2337
cgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcaga

SEQ ID NO: 140322 - DNA, 1580 bp, Homo sapiens
  Payload ID: 7530
  Gene Symbol: HPS1
  Gene Name: Hermansky-Pudlak syndrome 1
  Uniprot ID: Q92902
  ENST ID: ENST00000338546
  CDS Start-End: 222-1196
gcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaata

SEQ ID NO: 140323 - DNA, 978 bp, Homo sapiens
  Payload ID: 7530
  Gene Symbol: HPS1
  Gene Name: Hermansky-Pudlak syndrome 1
  ENST ID: ENST00000359632
  CDS Start-End: 1-978
cgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatg

SEQ ID NO: 140324 - DNA, 3678 bp, Homo sapiens
  Payload ID: 7530
  Gene Symbol: HPS1
  Gene Name: Hermansky-Pudlak syndrome 1
  Uniprot ID: Q92902
  ENST ID: ENST00000361490
  CDS Start-End: 210-2312
gggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcaga

SEQ ID NO: 140325 - DNA, 857 bp, Homo sapiens
  Payload ID: 7530
  Gene Symbol: HPS1
  Gene Name: Hermansky-Pudlak syndrome 1
  ENST ID: ENST00000414009
  CDS Start-End: 1-478
gctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactat

SEQ ID NO: 140326 - DNA, 3714 bp, Homo sapiens
  Payload ID: 7530
  Gene Symbol: HPS1
  Gene Name: Hermansky-Pudlak syndrome 1
  Uniprot ID: Q92902
  ENST ID: ENST00000613394
  CDS Start-End: 247-2349
ggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcatatctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcag

SEQ ID NO: 140327 - DNA, 4665 bp, Homo sapiens
  Payload ID: 7531
  Gene Symbol: HPS3
  Gene Name: Hermansky-Pudlak syndrome 3
  Uniprot ID: Q969F9
  ENST ID: ENST00000296051
  CDS Start-End: 141-3155
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcacaaccatgtgtcttcatttataactttttgtttaaaaaatttttagttcaagtttagttcattgatattatcctctgaatgcagttaaggctgggcagaaattctactcatgtgacatctgccacaggtctattttgaagcttttcttctaatggcaatgtttgtccttaccaggatttaatctatagaattgtctctcaactctgcttttctccagttccagataacgtccttaagaccatctgttcaggggttcacaaaactcaaatttgtgtcattctattttatttattttattttttatttccttccctcataccttgcccattccctctgaatattaggtgtgatgtcaacagcatgttagaaggatcaatgggaaggcaatgattgaaaacatttcaatgaaccttaatagtgttcctttgaggagcacccaggagaatatctggtcatagatctttttttaaatgcagttttataaaaccctaacagcggtgatatcattagactgtatgaatcagttttattacctagtgtacaagtgtcagtcatgtatcattatatagtctgttgatctttccatttgcaaaaaattaatagttttcccccacaaatgtacaaagttgtatgcttccagtcttcttttaatgtttatagtcattccaaagtaacattctattttacactttcacatacattgttatgaatcattggtttttctcttttttccacttatcaccaatttatttcattcagccagatttggtgtct

SEQ ID NO: 140328 - DNA, 2745 bp, Homo sapiens
  Payload ID: 7531
  Gene Symbol: HPS3
  Gene Name: Hermansky-Pudlak syndrome 3
  ENST ID: ENST00000460120
  CDS Start-End: 87-2606
ggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatat

SEQ ID NO: 140329 - DNA, 1958 bp, Homo sapiens
  Payload ID: 7531
  Gene Symbol: HPS3
  Gene Name: Hermansky-Pudlak syndrome 3
  ENST ID: ENST00000460822
  CDS Start-End: 1-801
gaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggatagactctgtggtggaaaaaactgttgcctgaactttgtcagagaataaaatgtggtggagagaagtatcaactctacctgtcatcattaaaagcttaattttcacgggaactgtggaagctagcagacagtaccactacattataaatgaggaacctaggacttggaagattaagtgactttcttaaagccactcgaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcacaa

SEQ ID NO: 140330 - DNA, 3786 bp, Homo sapiens
  Payload ID: 7532
  Gene Symbol: HPS4
  Gene Name: Hermansky-Pudlak syndrome 4
  Uniprot ID: Q9NQG7
  ENST ID: ENST00000336873
  CDS Start-End: 510-2636
gtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 140331 - DNA, 4497 bp, Homo sapiens
  Payload ID: 7532
  Gene Symbol: HPS4
  Gene Name: Hermansky-Pudlak syndrome 4
  Uniprot ID: Q9NQG7
  ENST ID: ENST00000398145
  CDS Start-End: 618-2744
ggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 140332 - DNA, 3562 bp, Homo sapiens
  Payload ID: 7532
  Gene Symbol: HPS4
  Gene Name: Hermansky-Pudlak syndrome 4
  Uniprot ID: Q9NQG7
  ENST ID: ENST00000402105
  CDS Start-End: 301-2412
agaccatgtggttgtatagttaaggttcagtgtttcaaataagagcagtcattgtgggcgcctcgtttttttttctagctactcgtgtcttctccggcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 140333 - DNA, 3492 bp, Homo sapiens
  Payload ID: 7532
  Gene Symbol: HPS4
  Gene Name: Hermansky-Pudlak syndrome 4
  ENST ID: ENST00000429411
  CDS Start-End: 68-643
agccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagctttgagctacaccctgtccagctgttctgtacaaccctttccccttttctcccttcctgattgtgagcatgctgatgggtgggcatgatgcctcttgccctgcacaggtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 140334 - DNA, 3936 bp, Homo sapiens
  Payload ID: 7532
  Gene Symbol: HPS4
  Gene Name: Hermansky-Pudlak syndrome 4
  ENST ID: ENST00000439453
  CDS Start-End: 551-1141
ggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagctttgagctacaccctgtccagctgttctgtacaaccctttccccttttctcccttcctgattgtgagcatgctgatgggtgggcatgatgcctcttgccctgcacaggtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 140335 - DNA, 1942 bp, Homo sapiens
  Payload ID: 7532
  Gene Symbol: HPS4
  Gene Name: Hermansky-Pudlak syndrome 4
  ENST ID: ENST00000422379
  CDS Start-End: 498-1942
ctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaag

SEQ ID NO: 140336 - DNA, 4277 bp, Homo sapiens
  Payload ID: 7532
  Gene Symbol: HPS4
  Gene Name: Hermansky-Pudlak syndrome 4
  ENST ID: ENST00000464362
  CDS Start-End: 166-669
ttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaaggacttctaggcccctgactccatacaaggaatgtggaactgaggcatatttccccgagtgaaagagcatgatgttttcattttatgtgatggaatagagtcatggaacctggtcagacatcaagccacctgtatcaccatggggattgtgcttcagaaggaaagtggaggatagggtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggtaagtagtgaggcgcatggttgcctcttgagaacggcggtcttttatgctacctacccctgtacaagttatgcgaaggaaaccaagccatctgcatgtttatttcctctgctcataataggaaaatggatgttatggagcttcaagaatcgagttacccaccagaaccctaatggtaaagctatgattttaggcatgctgtcaaatccctgctttcagaccctccttaacttcatattgtgagactgctcggtcaagtgccaggagattgtgattgggagagggtaaggcaaacagcgactgccagaaagaccttttgcaggatgtggaggcgtcctcaggagagttatttcgatttattctgaagcctgagttggagcagatccctttcttagcttatatcttcttcttgtaaaagtgcttttcaacctttctctcccgaacatcttccttctccaaagctgggagtcatgttgcctgcagggactctttccttactgggcccaggagttcgaggtgcagtttggcaacctgtgtcctggctgaggaatgcactcacagcacccctttccgagcccacgtgtgggttggatgcatcacgccagtgcagctattgccccgctgccctctctggctcaggggaaagtcctgttcatattgctttgcaattccaggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 140337 - DNA, 4491 bp, Homo sapiens
  Payload ID: 7533
  Gene Symbol: HPS5
  Gene Name: Hermansky-Pudlak syndrome 5
  Uniprot ID: Q9UPZ3
  ENST ID: ENST00000349215
  CDS Start-End: 279-3668
cgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaaggtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagct

SEQ ID NO: 140338 - DNA, 4725 bp, Homo sapiens
  Payload ID: 7533
  Gene Symbol: HPS5
  Gene Name: Hermansky-Pudlak syndrome 5
  Uniprot ID: Q9UPZ3
  ENST ID: ENST00000396253
  CDS Start-End: 464-3511
cgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaacaattcaa

SEQ ID NO: 140339 - DNA, 4147 bp, Homo sapiens
  Payload ID: 7533
  Gene Symbol: HPS5
  Gene Name: Hermansky-Pudlak syndrome 5
  Uniprot ID: Q9UPZ3
  ENST ID: ENST00000438420
  CDS Start-End: 277-3324
cgcgaggggagactgaagttcacgttccgctcttagtgcgcgtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagct

SEQ ID NO: 140340 - DNA, 2160 bp, Homo sapiens
  Payload ID: 7533
  Gene Symbol: HPS5
  Gene Name: Hermansky-Pudlak syndrome 5
  ENST ID: ENST00000531848
  CDS Start-End: 357-1559
gacgtcagcaaggaaggggaggaacgcgaggggagactgaagttcacgttccgctcttagtgcgcggtgagttccccggcgctaagccgggagacaagatccgatctactgagagctgcgagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaaggtgatgaatgtgtctgttgttggttcctgatgtgaagccattattttccacgagctcctgttaccaggattatcttgtgcacggaatttctctgaagtgttaataatttttaacatgttgatagaactttccatccagatctacagatctgccccctactagaagagttggtttatgtttagtattttttcccctcacgtttggactaacattagggcctgtttttgatcatgcatcaaaatgctggaaaggttatgaaagaaaggtcattaaccaaaagagtgggaagattttattctgactaaccaaattatttttcatcaggattgaaaaattactgcagtttttgggggtcattgccttcctttttcgatgtgcgagtattcctgtggctgaactagtgagaagagaataatagagatcctaaactccctttttgacttatggggactcagggttagtaggcaaatgaaggtacctgcctcggtgttttatgtggaccatcccatgcattttgtaaacctgtgttccactcatttgtttctgggtcagttgtgattttggtattgaatccttcatttctttcggtttattcatttcagaatttttttaaagattaaaacaactcccacgtga

SEQ ID NO: 140341 - DNA, 1275 bp, Homo sapiens
  Payload ID: 7533
  Gene Symbol: HPS5
  Gene Name: Hermansky-Pudlak syndrome 5
  ENST ID: ENST00000537258
  CDS Start-End: 167-958
ttttcttttttggccctttgacattttctttgttatcttggagcttggtcaccagcatttctagacattttgtagcagaagagttttcaagttatttcttcttctatattcatctcttaatcaggttttcttcacactccccacattttatgcttcctttcttagcatgaagattggtgacttttttccccaactttctcttaggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagacacttgaattgcttccactttctggctattgtgaataacgctgctatgaatatgagtatacaaatatgtcttccagacactgctttcagttctttcgggtatatacctgaaagtggaattctggaatcatatgggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctgg

SEQ ID NO: 140342 - DNA, 759 bp, Homo sapiens
  Payload ID: 7533
  Gene Symbol: HPS5
  Gene Name: Hermansky-Pudlak syndrome 5
  ENST ID: ENST00000544218
  CDS Start-End: 278-759
tttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaataaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaa

SEQ ID NO: 140343 - DNA, 2649 bp, Homo sapiens
  Payload ID: 7534
  Gene Symbol: HPS6
  Gene Name: Hermansky-Pudlak syndrome 6
  Uniprot ID: Q86YV9
  ENST ID: ENST00000299238
  CDS Start-End: 86-2413
gctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatatata

SEQ ID NO: 140344 - DNA, 2474 bp, Homo sapiens
  Payload ID: 7535
  Gene Symbol: HERPUD2
  Gene Name: HERPUD family member 2
  Uniprot ID: Q9BSE4
  ENST ID: ENST00000311350
  CDS Start-End: 633-1853
aacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaa

SEQ ID NO: 140345 - DNA, 3057 bp, Homo sapiens
  Payload ID: 7535
  Gene Symbol: HERPUD2
  Gene Name: HERPUD family member 2
  Uniprot ID: Q9BSE4
  ENST ID: ENST00000396081
  CDS Start-End: 806-2026
aacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcaggtaccccagtgcccgctgaccgccctgagcggcccagctgcttccccgatccgcaccgcggggccgtggcgtaggggccttgttgcgttccagcttgggggtcgcggtggggcggggcagtgaccccgggccggccgttgtgccctcatccctcccacccttccttcgtatagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaa

SEQ ID NO: 140346 - DNA, 808 bp, Homo sapiens
  Payload ID: 7535
  Gene Symbol: HERPUD2
  Gene Name: HERPUD family member 2
  ENST ID: ENST00000413517
  CDS Start-End: 237-808
ggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaa

SEQ ID NO: 140347 - DNA, 672 bp, Homo sapiens
  Payload ID: 7535
  Gene Symbol: HERPUD2
  Gene Name: HERPUD family member 2
  ENST ID: ENST00000427455
  CDS Start-End: 491-672
gctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccaagttcagatcattcaggatcaacaactccatcatc

SEQ ID NO: 140348 - DNA, 811 bp, Homo sapiens
  Payload ID: 7535
  Gene Symbol: HERPUD2
  Gene Name: HERPUD family member 2
  ENST ID: ENST00000438224
  CDS Start-End: 272-811
acagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccaagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaac

SEQ ID NO: 140349 - DNA, 505 bp, Homo sapiens
  Payload ID: 7535
  Gene Symbol: HERPUD2
  Gene Name: HERPUD family member 2
  ENST ID: ENST00000603731
  CDS Start-End: 450-505
aagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatca

SEQ ID NO: 140350 - DNA, 4105 bp, Homo sapiens
  Payload ID: 7536
  Gene Symbol: HHLA1
  Gene Name: HERV-H LTR-associating 1
  Uniprot ID: C9JL84
  ENST ID: ENST00000414222
  CDS Start-End: 1-1596
atgctgggcttcctgtcacgtggtccttcaatgaagctgtgcatgggcctggcatgtgtcttgtccctttggaacacagtgtctggcatcaaaggagaagccaagaaagagaagggaatgacctttttacctacaacagtgtctggccttagagaagaagagaggaaggagaagggggtggcatttcttgctacgacggagctgcccgcaaggtcaatcgatctgtccgcgcttaacctgacagagcttgtgaatgggatgctcagtagagcgttaaaagatagcaagaagttcttctccttgctgagtgtcacttcctacagttccttcgccttccacaagttttctgtagctgtttacaacatttctaacctgaagacagtagaccccgccaaattccccacaaggtattgctactgtttaaacaatcggaccaatgacttatcagattttacagctctactggtagatatcatcggcaattctaccagctacctcacagagatttttaagtcaacctccatcctctcagtgaatcaaagcaatgaatcagattgcatcttcatctgtgtgatgacaggaaagtcaggaaggaatctttctgacttctgggagatagaagaaaaatatcccattatcaattacacatttaccagcggcttgtctggtgttctgggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctaccttgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagatactgtcttgaatactattcctggtttctgaagaatgcaacatatatctgtcagagggtgaaaagggtgtcccactcgcacaccttaaagcaaaagtgccttgagaatatctgcaagtctgtgtgaggccttgaaaataacactagggcataacaattacttcaggggatacgccatccaccctggctcttgtcccaagtgggctacatttgaagaattcacccaggctccagctagatcatcagttaatttaaagtggttattcttggaagtagcattttttttccctctcctgtgaatctgtgcaaaacattgaaggtagaagttttcttgttagaggcctcacaattaatacagtaatgccagactccttgcctgcttcaaaatcatggaaatctagtgttcatgctcaagaaactcctacaatgcttgaggcaatcctgacaatttaaaaactggggatgcgtgggcactctagcctgcacaaaccagttcagccatggagactctgacacaatacctgaggtgacttaaacttgagacttttgaaagacaacaaaagcataaattaatattgaattcatactctagagagattcacatatactgatagttaactaatacatgtacaaccaatcagacttgccatggtatgggatctatataatcttccaagcccccttaagtgggcgataatgaaaactttatcattaggaggaggtttagagagttgtttttattgacatcttgtcttgattcctcttctgtgtgacccactggattcagaggtccccatgagcaccctcaggttcaatgattcatgagtagaactcagaggtagggaaaactgttatatgcacatttagcatttattacaacaaaaggatgcagatgaaaagcagcaaatgtgaaaggcacctctagagagagtccaagagagcccaggcacaagcttccagtggggttgcacagtcagcatctaatcctcccagaaataatgtttaacaacacgtggagtattgtcagccaggaaagctcatccaagttttggtgtccaggggatgtttgggggtatggagtaggtatggagtgccttcatggcctgcatggctaaacttagttattcagtctccagtccctctagaggtcaagctgatactgcacgacctaaggccccaccataaatcacattgttaacataaactatctgtcatggcacgaagccccaggtacaagagacactcatcaggcaggatattccaaggatttacaggggattccccaggagctggtcaaggaccagatgttcctctgaaaggtgcaggatttgagctcatctgtggagtacgtctgtggagtcaactttcttctgcatccccacatactgatttgccaccttcattgtatcagattcctttttcactatattcaggtttgcggttgctccagtatccctatctatgctgagtctccacgtagagcatgtgtgccctctccagtggctctgcacggaccccttatttctcattaccagggacagtttttctcctgatgtgcctggtgctccttctccactctcttgccttaggactctgctgggccatgagtattttttttacccttttgtgacctagggctgcccttgggtgaggaaagtcactttctgttcatcatctaagtagaaaacagtttctgccattggaagacccctgagttccctggcactcctgtgaaccacaaggtgcctggggaggtagaacttggacattggagagaggagcagccagacatttctctttctaatcatatgcagaaagatttctttttattctccagaacacttgaaagactctccaagttatgcaaatgtcaagctcataaatgtatattatcatgacttttgcaaagatgaagaggatacagcaaattttctgggaggcaaagggacttctacctggataggaaccaagcaaactcattaagcatggattaatttgattcaacccttgcgtggatattaattaaggacctttgacaggagagggtcctcaaggttcctcaaagagtaacttatcatcaaggaaggtgaagaatggatggatggcttgggcccaagactggggctattcacttgtggggaaacccatgtgaacccagttaccccatactttgggaataatgactgagcatgactataatctttaagaagctcaaatgcggaatacctctgaggcttatgcaaggatctggcctagcatcaaggacaaaggctcagaggactccttggggccagttttctacagtcataccatcagccacaacagcagcaaaggcagaaggaaaacagggcccaggagtggctgacgactgcctggagtccaactggtctcctggagttcataagaggtttgaccccttctgagctgaatgtgtcctgatttaggggatagctagggcaataagaaagcctcagggggtgctactgatctggaactcctactaattagtgtgtatgtatgtggccaccagtggttagcagatgaggtgaaagagatgggacagtgactgtatctgttctgatgaaggagattgtgcagttacatgcgtaacgtcattaaacttcattcttccaggt

SEQ ID NO: 140351 - DNA, 2369 bp, Homo sapiens
  Payload ID: 7536
  Gene Symbol: HHLA1
  Gene Name: HERV-H LTR-associating 1
  ENST ID: ENST00000434736
  CDS Start-End: 87-1718
gttaatctttctagctgtttaagttctttgaagtcaatttatcctgctcagaagataggtaagtagtgggccagagtatcacaagcatgctgggcttcctgtcacgtggtccttcaatgaagctgtgcatgggcctggcatgtgtcttgtccctttggaacacagtgtctggcatcaaaggagaagccaagaaagagaagggaatgacctttttacctacaacaggtaagtgggtgataagggctccttttcagctcacttgtctggaaataaagatgttaagaaggaaaaagatgggacattcccgggcagccctaaatcctgacttactcttgtctggccttagagaagaagagaggaaggagaagggggtggcatttcttgctacgacggagctgcccgcaaggtcaatcgatctgtccgcgcttaacctgacagagcttgtgaatgggatgctcagtagagcgttaaaagatagcaagaagttcttctccttgctgagtgtcacttcctacagttccttcgccttccacaagttttctgtagctgtttacaacatttctaacctgaagacagtagaccccgccaaattccccacaaggtattgctactgtttaaacaatcggaccaatgacttatcagattttacagctctactggtagatatcatcggcaattctaccagctacctcacagagatttttaagtcaacctccatcctctcagtgaatcaaagcaatgaatcagattgcatcttcatctgtgtgatgacaggaaagtcaggaaggaatctttctgacttctgggagatagaagaaaaatatcccattatcaattacacatttaccagcggcttgtctggtgttctgggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctaccttgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagttctttcataaatccctaccaatcatccaccagcaaaataagttggaaaacttaaattaaaaagcagaacctgttttatattaagaaggtctagacatggacattttctgtcctacaatgctgacatactgttatttcttctgggatttattcttggctgtaaacccagaactaaattacatagatgaatactcctgctccagtggcctggataccaatctctcctgtctttaatgttattttcaaagactactctcaagatccattagcttttaaaatttctgcctctgagtctgaagcccaggtggacagccattttccatcacccctttccagctgtaatctttcatccccctcccccccccccccgtcagtacgaacatttcctccattcatagagggcaataagcaagacctgtagacccaaagcacaggtttattctaaagaaaacttttacgacaatactttctgtattgtctaggttaagcccactttaggagatcctttactcattaacttaaccaacaatgtgtattgagtctctgctgtatatctgtgatgctctgtcccaagccatggggatctagaggtgaatcagaaatagcctcagaaactgagggtttcatagttggaaggaagaaatggtcataaacacaaatcaaaatatagtattatagatcatagaaccaagtcacgtaaccaggc

SEQ ID NO: 140352 - DNA, 2666 bp, Homo sapiens
  Payload ID: 7537
  Gene Symbol: HHLA2
  Gene Name: HERV-H LTR-associating 2
  Uniprot ID: Q9UM44
  ENST ID: ENST00000357759
  CDS Start-End: 415-1659
agttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 140353 - DNA, 2406 bp, Homo sapiens
  Payload ID: 7537
  Gene Symbol: HHLA2
  Gene Name: HERV-H LTR-associating 2
  Uniprot ID: Q9UM44
  ENST ID: ENST00000489514
  CDS Start-End: 155-1399
agtttactctacatcatagcagagaaaatggacaaaacacagctgttttgcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 140354 - DNA, 573 bp, Homo sapiens
  Payload ID: 7537
  Gene Symbol: HHLA2
  Gene Name: HERV-H LTR-associating 2
  ENST ID: ENST00000482430
  CDS Start-End: 166-573
attcttatggactacttagcatttgactagacggtatgaatttctaagtaagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgcta

SEQ ID NO: 140355 - DNA, 1439 bp, Homo sapiens
  Payload ID: 7537
  Gene Symbol: HHLA2
  Gene Name: HERV-H LTR-associating 2
  ENST ID: ENST00000491820
  CDS Start-End: 246-1439
ttattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagaaagatgttgtgtccctcctggtgagcgctgtcccagtgcacccgataatggcgaagaaaatgtgcctctttcaggaaaagtatag

SEQ ID NO: 140356 - DNA, 1457 bp, Homo sapiens
  Payload ID: 7537
  Gene Symbol: HHLA2
  Gene Name: HERV-H LTR-associating 2
  Uniprot ID: Q9UM44
  ENST ID: ENST00000467562
  CDS Start-End: 175-1227
tattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaa

SEQ ID NO: 140357 - DNA, 2659 bp, Homo sapiens
  Payload ID: 7537
  Gene Symbol: HHLA2
  Gene Name: HERV-H LTR-associating 2
  ENST ID: ENST00000482099
  CDS Start-End: 1-985
gattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 140358 - DNA, 2379 bp, Homo sapiens
  Payload ID: 7537
  Gene Symbol: HHLA2
  Gene Name: HERV-H LTR-associating 2
  Uniprot ID: Q9UM44
  ENST ID: ENST00000467761
  CDS Start-End: 128-1372
atttctcatctcagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaa

SEQ ID NO: 140359 - DNA, 585 bp, Homo sapiens
  Payload ID: 7537
  Gene Symbol: HHLA2
  Gene Name: HERV-H LTR-associating 2
  ENST ID: ENST00000462629
  CDS Start-End: 295-585
ttcttatggactacttagcatttgactagacggtatgaatttctaagtaagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataat

SEQ ID NO: 140360 - DNA, 594 bp, Homo sapiens
  Payload ID: 7537
  Gene Symbol: HHLA2
  Gene Name: HERV-H LTR-associating 2
  ENST ID: ENST00000463019
  CDS Start-End: 161-594
gtttattcttatggactacttagcatttgactagacggtatgaatttctaagtaagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgt

SEQ ID NO: 140361 - DNA, 568 bp, Homo sapiens
  Payload ID: 7537
  Gene Symbol: HHLA2
  Gene Name: HERV-H LTR-associating 2
  ENST ID: ENST00000467282
  CDS Start-End: 185-568
atagctgaattcaatgtttattcttatggactacttagcatttgactagacggtatgaatttctaagtaagcatgtaggagaatactaaccctgcacagattgtgatggtgatgtggaatatactaaagcctagaacgcacctcctctggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtg

SEQ ID NO: 140362 - DNA, 2548 bp, Homo sapiens
  Payload ID: 7537
  Gene Symbol: HHLA2
  Gene Name: HERV-H LTR-associating 2
  Uniprot ID: Q9UM44
  ENST ID: ENST00000619531
  CDS Start-End: 302-1546
aaatcaaacgtaccttggactttactctctgagaaactcatagctgaattcaatgtttattcttatggactacttagcatttgactagacggtatgaatttctaagtaagcacatatagaactggatgcccttgtggtacatctcaaggctgatttgaaagcttgagagaccatcaagaattggatttggggaagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcac

SEQ ID NO: 140363 - DNA, 898 bp, Homo sapiens
  Payload ID: 7538
  Gene Symbol: HHLA3
  Gene Name: HERV-H LTR-associating 3
  Uniprot ID: Q9XRX5
  ENST ID: ENST00000359875
  CDS Start-End: 141-485
gaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaa

SEQ ID NO: 140364 - DNA, 692 bp, Homo sapiens
  Payload ID: 7538
  Gene Symbol: HHLA3
  Gene Name: HERV-H LTR-associating 3
  Uniprot ID: Q9XRX5
  ENST ID: ENST00000361764
  CDS Start-End: 148-378
attcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttccttt

SEQ ID NO: 140365 - DNA, 775 bp, Homo sapiens
  Payload ID: 7538
  Gene Symbol: HHLA3
  Gene Name: HERV-H LTR-associating 3
  Uniprot ID: Q9XRX5
  ENST ID: ENST00000370940
  CDS Start-End: 117-482
gaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgca

SEQ ID NO: 140366 - DNA, 541 bp, Homo sapiens
  Payload ID: 7538
  Gene Symbol: HHLA3
  Gene Name: HERV-H LTR-associating 3
  Uniprot ID: Q9XRX5
  ENST ID: ENST00000531950
  CDS Start-End: 109-453
gtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtcttgtcaacggaaaggggtccctatccagaccccaagagagcattcttggatctcttgcaagaaagaatttgaggcgaatccatagagtaagatggagttttgctcttgttgcccaggttggagtgcagtggtgtgatcttgactcactgaaacctccgcctcctgagttcaag

SEQ ID NO: 140367 - DNA, 832 bp, Homo sapiens
  Payload ID: 7538
  Gene Symbol: HHLA3
  Gene Name: HERV-H LTR-associating 3
  Uniprot ID: Q9XRX5
  ENST ID: ENST00000463058
  CDS Start-End: 124-354
cgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtcttgtcaacggaaaggggtccctatccagaccccaagagagcattcttggatctcttgcaagaaagaatttgaggcgaatccatagagtaagcaaggcaagttacttctatatagaagggtgcacccttacagatcaaacaatgcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaa

SEQ ID NO: 140368 - DNA, 689 bp, Homo sapiens
  Payload ID: 7538
  Gene Symbol: HHLA3
  Gene Name: HERV-H LTR-associating 3
  ENST ID: ENST00000525653
  CDS Start-End: 98-322
cagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccattgactcttttcgccgacaccttgtatttcgtctggcaaccttactcacccctcaaccatttgtttgagttgtttagagttatggatatagttaaagtacgaagccaaatgtgtgggaataataacgccaaattcaagatagtggtttcaatggagcacgaaggagaaaaacaccatcaggggtcttgtcaacggaaaggggtccctatccagaccccaagagagcattcttggatctcttgcaagaaagaatttgaggcgaatccatagagtaagcaaggcaagttacttctatatagaagggtgcacccttacagatcaaacaatgcttagtgatgtgtgtcagacctctgagcccaagcaaagccatcatatcccctgtgacctgcatgtatacatccagatggcctgaagcaagtgaagaatcacaaaaga

SEQ ID NO: 140369 - DNA, 1578 bp, Homo sapiens
  Payload ID: 7539
  Gene Symbol: HES1
  Gene Name: hes family bHLH transcription factor 1
  Uniprot ID: Q14469
  ENST ID: ENST00000232424
  CDS Start-End: 237-1079
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatcca

SEQ ID NO: 140370 - DNA, 4262 bp, Homo sapiens
  Payload ID: 7540
  Gene Symbol: HES2
  Gene Name: hes family bHLH transcription factor 2
  Uniprot ID: Q9Y543
  ENST ID: ENST00000377834
  CDS Start-End: 100-621
actcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggagaactccaactgctcgaagctagagaaggcagacgtcctggaaatgaccgtgcgcttcctgcaggagctgcctgcgtcctcatggcccacggcagcgcccctgccttgcgacagctaccgcgagggctacagcgcctgtgtggcgcgcctggcccgcgtgctgcccgcctgccgtgtcctggagcccgccgtgagcgcgcgcctgctggagcacctgtggcggagagcggccagcgccaccctggacggcgggcgcgctggggattccagtggcccgtctgcccccgccccagcgcccgcgtctgccccagagcccgcatccgctccggtgccctcgccgccctcgcctccctgcggccctggcctctggcggccgtggtagcccctcggccgatccacagaccctgccgactgcttgggaccttggggcactggacaggttgaagctcttggtggcggctgctgttcccatcattaggggccagcccagtacccacacccaggccggaagccggctgtttgtgactggcgtggcagactgaaagccctggggctggggctcggctcagggaataaaaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgggaccctctgggcatgcagcagcagtagcctaagggctctggtcacttccagggctctacagggcagcagagcagagcaaaagggtgcatatgctgggagctgtcacctccactcctaggcttttctgcctagagcagaattataggggcagtatacatccaggggtctgtgcggtggggctgggggattccttaagtgactttgggaaggatttgttttcccgagcatcaatttcacacctgggcattgcaccccaggctatgcagtctttcagtgtgaggaaggggcagaacaagaatgaggcggccccgtggcctcaaggaagcttgtggctttggaggatctgactccagcagagtctgtgccaatgtggggtgagcagggcccctgccatggagcagcaggaatttgagggatggagcaggttaaagaatgggaaacatcttcacttgtttttttttcttgcaaactactccctgctactcattgagactggttactggaagcaacttgttaagatttttctttctgggcgggcgcggtggctcacgcctgtaatcccagcactttgggaggccaaggcgggtggatcacctgaggtcaggagttcgagaccagcttagccaatatggtgaaaccccgtctctactaaaaatacaaaaattagccgggtgtggtggcatgtgccagctactcgggaggctgaggcaagagaatcacttgaacctcggaggctgaagttgcagtgagccaagattgagccattgctctccagcctgggtgacacagcaagactctgtctcaaaaaaaattttttatttctttcttttccatggaggcctagagtccctgtgaaggctaggaaggggctgctgatcccaggagtgcccacgaggagtggggggcactgttggcccataatcaggcaaacacccatcatttcatgggggattcatgaaatcatagtcaggcaaacacccgtcatttcatggctaagcatttgcagaaggtggaggattctcccccgagtccccaaatcagcagcctgtgctagggaccagagcaccgggggcaagaagacagaaccaatgtgggagtggggatggtcactaaatctgactgtgccacacaagcccatgatgaccttggcactggtttgggtggcaggatatgaaggaagctgtaggcattattgaaaaaatcattgttcagccaacagggtgaggctcccagcaaggccgtgccatcttcccacctccctgtgcccagagggttagactgtaagctcccggagggcgaggctggggctgagcgtgcctccacgtccccaaggcacagggtgcacagtgggtgctcactgaatatagtggactagtgagcagaggatgagaggactaccctgtaatgagccttggacagtctggcatttgccttaactcccactcccatgccctgggatcactgttggatatttactccatgaggacaaatactggggaggtgtggagaggagggagggcaggttcctcttactttcacccattgctgagaatgagcgcctgttggcactgcctttgtgagcctccgggagcaggtaacctgcggcccaagcccgcctaggactccacatcaggcaggcacaggactggccccttgtcctcataaaaactctcagtacagcttaaactctgtaagatctaaccagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcctcaggtgccccccaagccctatctgatgggcaaaggtgaacgcagggcggtgggcttttcctgtgcagagggagactgattcaaagggtcatttatgacctttcacaagtcccacatcctgcccaatggccaggtcttgggatgctgttgcaagatggttctgtgactccatgtgactgtctgatgattgccccagctggggaaaaggctcccatgtctctttctcataaaaccagtgggcaaggccgggcgcagtggctcacgtctgtaatgccagcacttcgggagaccaaggtgggcggatcacctgaggtcaggagttcaagaccagcctgaccaacatggtgaaaccccgtctctacaaaaatatggaaattagctgggcatgacggcgggtgcctgtaaccccagctacttgggaggctgaggagggataatcagttgaacccaggaggtggaggttgcagtgagccgagatcgcgccactgcactccagcctgggtgacagagcaagactccatctcaaaaacaaacaaacaaaaaactagcgggtgaaatgattcagtgacctaaggacagccagagcactaagctgctgggaacccatctgtgctgaaatgtagatttcccaggaaactcaggcttgggacaggcgcctacctgctcctcgggcaccaggtgattaggagaggtcgaatctcatttccacgtgagtgaggataaagactgggctgccaaggaggactcctcataaacattgacaaattgctctgccccgcctgtgatcccagacgactcctgcagtctgggatcctgagtgtcctgtgggttcatctcggatgggcgctgcataaacagcctgcagggaacgtctgggagaaccagcttcacaacagatataataaggaagaagtttgaaatattgcaagaattgcgaaagtgtgacacacagatacaaagtgggcacatgctcgtgggaaaatgttgccaatagacttgcttgactctggagttaccccgaaccttcaatttgtttaaaaaaaaaaaaaggcaatatcttgacgtgcaataaagtgaactgcaataaaa

SEQ ID NO: 140371 - DNA, 507 bp, Homo sapiens
  Payload ID: 7540
  Gene Symbol: HES2
  Gene Name: hes family bHLH transcription factor 2
  Uniprot ID: Q9Y543
  ENST ID: ENST00000377836
  CDS Start-End: 84-314
cccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtg

SEQ ID NO: 140372 - DNA, 1222 bp, Homo sapiens
  Payload ID: 7540
  Gene Symbol: HES2
  Gene Name: hes family bHLH transcription factor 2
  Uniprot ID: Q9Y543
  ENST ID: ENST00000377837
  CDS Start-End: 217-447
cgcggggacactcgtgcgactggggcaaggtgcccaggggcttctctcctaatttgcctcacgtaacagttgagaccccagagggcagcaaaactgggttcgaattggagagccgtccaggcacagacaaattcattcatctgcccagtgcccgctaactgcggttccaggcgccggcgacgcaattccagagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtgcaattcagatgtccaggcccacttccagaagttctcattccctgtgcttgagtcaatggccgcagaccatacacctgagagcaagttaatctgctctaacaaagatatcacatctaagaatggtggttggcaggggctggggggtgggaagaatggggagttggtgcttcatgggtacagagattcagttttgcaagaggaaaagagctctggagatggatgctgctgatggctacaccgcaatgtgaatgtgcatgatgcttaaatatggttaagatgggccgggcgcggtggctcacgcctgtaatcccagcactttgggaggccgaggcgggcagatcacgaggtcaggagatcgagaccatcttggctaacacggtgaaaccccatctctactataaatacaaaaaattagccgggcgtgggggcgggcacctgtggtcccagctactcgggaggctgaggcaggagaatggcatgaacctgggaggtggagcttgcagtgagccgagatcacgccactgcactccaggctgggcgacagagcgagactccgtctcaaaaaaaaaaaaaaaaaaaaaa

SEQ ID NO: 140373 - DNA, 968 bp, Homo sapiens
  Payload ID: 7540
  Gene Symbol: HES2
  Gene Name: hes family bHLH transcription factor 2
  ENST ID: ENST00000487437
  CDS Start-End: 88-321
ccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggagtgccttgcgacagctaccgcgagggctacagcgcctgtgtggcgcgcctggcccgcgtgctgcccgcctgccgtgtcctggagcccgccgtgagcgcgcgcctgctggagcacctgtggcggagagcggccagcgccaccctggacggcgggcgcgctggggattccagtggcccgtctgcccccgccccagcgcccgcgtctgccccagagcccgcatccgctccggtgccctcgccgccctcgcctccctgcggccctggcctctggcggccgtggtagcccctcggccgatccacagaccctgccgactgcttgggaccttggggcactggacaggttgaagctcttggtggcggctgctgttcccatcattaggggccagcccagtacccacacccaggccggaagccggctgtttgtgactggcgtggcagactgaaagccctggggctggggctcggctcagggaataaaaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgg

SEQ ID NO: 140374 - DNA, 730 bp, Homo sapiens
  Payload ID: 7540
  Gene Symbol: HES2
  Gene Name: hes family bHLH transcription factor 2
  ENST ID: ENST00000489730
  CDS Start-End: 98-346
tcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggagaactccaactgctcgaagctagagaaggcagacgtcctggaaatgaccgtgcgcttcctgcaggagctgcctgcgtcctcatggcccacggcagcgccccgtgagtgagccctccctgccctgccgcgcgctctgcaccccgcacccggcaccctaccccgcgcctcacgcggctctccgcccgcagtgccttgcgacagctaccgcgagggctacagcgcctgtgtggcgcgcctggcccgcgtgctgcccgcctgccgtgtcctggagcccgccgtgagcgcgcgcctgctggagcacctgtggcggagagcggccagcgccaccctggacggcgggcgcgctggggattccagtggcccgtctgcccccgccccagcgcccgcgtctgccccagagcccgcatccgctccggtgccctcgccgccctcgcctccctgcggccctggcctctggcggccgtggtagcccctcggccgatccacagaccct

SEQ ID NO: 140375 - DNA, 697 bp, Homo sapiens
  Payload ID: 7541
  Gene Symbol: HES3
  Gene Name: hes family bHLH transcription factor 3
  Uniprot ID: Q5TGS1
  ENST ID: ENST00000377898
  CDS Start-End: 66-626
tgggcacggagcctgctgcccggggcagcctccccggcaacttccgaaagatttccaagccgctgatggagaaaaagcgccgggcacgcatcaatgtgtcactggagcagctcaagtcgctgctggagaaacactactcgcaccagatccggaagcgcaaattggagaaggccgacatcctggagttgagcgtgaagtacatgagaagccttcagaactccttgcaagggctctggcctgtgcccaggggagccgagcaaccgtcgggcttccgcagctgcctgcccggcgtgagccagctccttcggcgcggagatgaggtcggcagcggcctgcgctgccccctggtgcccgagagcgccgccggcagcaccatggacagcgccgggttgggccaggaggcgcccgcgctgttccgcccttgcacccctgccgtctgggctcctgctccggccgccggcggcccgcggtccccaccacccctgctcctcctccccgaaagtctccctggctcgtccgccagcgtccccccgccgcagccagcgtcgagtcgctgcgccgagagtcccgggctgggcctgcgcgtgtggcggccctggggaagccccggggatgacctgaactgaaggcgctccctatttggtctcgcgacacagggactattttcagcacgcccacagtgactgccaggaccccc

SEQ ID NO: 140376 - DNA, 899 bp, Homo sapiens
  Payload ID: 7542
  Gene Symbol: HES4
  Gene Name: hes family bHLH transcription factor 4
  Uniprot ID: Q9HCC6
  ENST ID: ENST00000304952
  CDS Start-End: 139-804
ggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattcca

SEQ ID NO: 140377 - DNA, 1040 bp, Homo sapiens
  Payload ID: 7542
  Gene Symbol: HES4
  Gene Name: hes family bHLH transcription factor 4
  ENST ID: ENST00000428771
  CDS Start-End: 200-943
gggaaagaatgcggagccgggttcacacaccccgcggcggcgaggccttaaatagggaaacggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaaggtggggtcccggccgggcgtgaggggggcgaccggggggcgggagggacgcgggactcagccggtgcccgacccgcagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattccaga

SEQ ID NO: 140378 - DNA, 667 bp, Homo sapiens
  Payload ID: 7542
  Gene Symbol: HES4
  Gene Name: hes family bHLH transcription factor 4
  ENST ID: ENST00000484667
  CDS Start-End: 9-578
ggcgcaccatggccgcagacacgccggggaaaccgagcgcctcgccgatggcaggagcgccggccagcgccagccggaccccagacaagccccggagcgcggccgagcaccgcaagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttatt

SEQ ID NO: 140379 - DNA, 1306 bp, Homo sapiens
  Payload ID: 7543
  Gene Symbol: HES5
  Gene Name: hes family bHLH transcription factor 5
  Uniprot ID: Q5TA89
  ENST ID: ENST00000378453
  CDS Start-End: 82-582
cgcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgactgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaagccttcgtcgccgccgccggccccaagagcctgcaccaggactacagcgaaggctactcgtggtgcctgcaggaggccgtgcagttcctgacgctccacgccgccagcgacacgcagatgaagctgctgtaccacttccagcggcccccggccgcgcccgccgcgcccgccaaggagcccaaggcgccgggcgccgcgcccccgcccgcgctctccgccaaggccaccgccgccgccgccgccgcgcaccagcccgcctgcggcctctggcggccctggtgacccggcgggacctgcgggcgcgcggcccgacgaccagagggcgagcctgctcctctcgcctgtagggaagcgccttcccgccgtcgtccgccccgggcttggacgcgcccttctccggaaggctctggccccaagctggccggcccgcaggagccccattctcagagaatgtgtgtgcagagtccctgccgttttaggacaatcagggcccatcttctgccaagtgtctgaccccatggggttgttctgtgtttgcatttaagcaagtgacttctgggaagtccccggccgcccggggttctatgatatttgtagtgccggggctcgcacactgctgcccccagcctgtagaggactttcttcagggcccgtagctgctgggcgtacccctggcaggcgggctgtgccgcgggcacatttgccttttgtgaaggccgaactcgagctgtatcctcataggaaacagtgatcaccccggacgggcgtccaggaccctgagggccatggccaaaaggctcctgagtgtgcctggtggtctggctggggctcacggtgggctgtctggggagggtgggtgcctccactatgatccttaaaggattcctctgtgtgggtggatgcgtgtgggcacgactttgtactcagaaattgaactctcagtcacgtggaagccacgggactgctccgaagccgccataataaaatctgattgttcagcccccaa

SEQ ID NO: 140380 - DNA, 1306 bp, Homo sapiens; identical to SEQ ID NO: 140379
  Payload ID: 7543
  Gene Symbol: HES5
  Gene Name: hes family bHLH transcription factor 5
  Uniprot ID: Q5TA89
  ENST ID: ENST00000612705
  CDS Start-End: 82-582

SEQ ID NO: 140381 - DNA, 1454 bp, Homo sapiens
  Payload ID: 7544
  Gene Symbol: HES6
  Gene Name: hes family bHLH transcription factor 6
  Uniprot ID: Q96HZ4
  ENST ID: ENST00000272937
  CDS Start-End: 220-894
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 140382 - DNA, 738 bp, Homo sapiens
  Payload ID: 7544
  Gene Symbol: HES6
  Gene Name: hes family bHLH transcription factor 6
  Uniprot ID: Q96HZ4
  ENST ID: ENST00000409574
  CDS Start-End: 137-475
cggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcc

SEQ ID NO: 140383 - DNA, 528 bp, Homo sapiens
  Payload ID: 7544
  Gene Symbol: HES6
  Gene Name: hes family bHLH transcription factor 6
  ENST ID: ENST00000409356
  CDS Start-End: 120-404
gcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcgggccggggccatgggcgagcaagcgggcgggaggccgtgcggggctgggattcagtgccccgctccccgcaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgt

SEQ ID NO: 140384 - DNA, 1286 bp, Homo sapiens
  Payload ID: 7544
  Gene Symbol: HES6
  Gene Name: hes family bHLH transcription factor 6
  Uniprot ID: Q96HZ4
  ENST ID: ENST00000409002
  CDS Start-End: 67-735
ctccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagtt

SEQ ID NO: 140385 - DNA, 1600 bp, Homo sapiens
  Payload ID: 7544
  Gene Symbol: HES6
  Gene Name: hes family bHLH transcription factor 6
  Uniprot ID: Q96HZ4
  ENST ID: ENST00000409160
  CDS Start-End: 134-778
aagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttaccctt

SEQ ID NO: 140386 - DNA, 863 bp, Homo sapiens
  Payload ID: 7544
  Gene Symbol: HES6
  Gene Name: hes family bHLH transcription factor 6
  ENST ID: ENST00000409182
  CDS Start-End: 54-641
cgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtggg

SEQ ID NO: 140387 - DNA, 530 bp, Homo sapiens
  Payload ID: 7544
  Gene Symbol: HES6
  Gene Name: hes family bHLH transcription factor 6
  ENST ID: ENST00000450098
  CDS Start-End: 97-530
gcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgct

SEQ ID NO: 140388 - DNA, 512 bp, Homo sapiens
  Payload ID: 7544
  Gene Symbol: HES6
  Gene Name: hes family bHLH transcription factor 6
  ENST ID: ENST00000436051
  CDS Start-End: 1-512
gtgctggcggagggcggcgtcgggggtccggcccggcgtctggacgagtccggaagaaactcaggggccgccccgccaccgctgcccaatggaccctgcctccccggggcttggcagccaccccagccgggacctgaaacccctctaggtccagagaccgcggacttgactgtggctctgcacaccagggacgcatctcctggggccagtggccccagcgctcaactctggaggcgccatcggcgaaggagggaaatgaatgaattaatgggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgc

SEQ ID NO: 140389 - DNA, 474 bp, Homo sapiens
  Payload ID: 7544
  Gene Symbol: HES6
  Gene Name: hes family bHLH transcription factor 6
  ENST ID: ENST00000417803
  CDS Start-End: 1-51
cgggcgccgaggtgcaggccaagctggagaacgccgaagtgctggagctgacggtgcggcgggtccagggtgtgctgcggggccgggcgcgcggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctc

SEQ ID NO: 140390 - DNA, 678 bp, Homo sapiens
  Payload ID: 7545
  Gene Symbol: HES7
  Gene Name: hes family bHLH transcription factor 7
  Uniprot ID: Q9BYE0
  ENST ID: ENST00000317814
  CDS Start-End: 1-678
atggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccgggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctga

SEQ ID NO: 140391 - DNA, 1674 bp, Homo sapiens
  Payload ID: 7545
  Gene Symbol: HES7
  Gene Name: hes family bHLH transcription factor 7
  Uniprot ID: Q9BYE0
  ENST ID: ENST00000541682
  CDS Start-End: 1-693
atggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccggccgccgcggctccaggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcggggtctaggggtggggtagagactccagcccgagggcagcagagggacccgggcgtccgggcgagcaggtgttggggagggcagtggggcgcgcgggctcagcgcgcgggtgagatgtggtctatattagagtatctatataaatatatatttccctggttcctgtcccttttccctgccccaacttctcccttgcgtctaggattgtactctctctgcccctcagcccagtcccagtcccttcccgagtccctagtgcatggaataaagtggttattaaatccccgtgtgtccccgagccaggggcctgcctttatctcgacgtccacgcccactttcccttcccttctgtctcccaccctcagtcctgctctccatggcccaagccccggggcagacaggtaagtaaagaagagagcagagcgggaactgagatcgaaattgaaaccaggtggaaagagagagatagggtagggggagaagggatgggggcctttaagaaaaaaacggataaaaaggaaaaattgaaataaaatcgactctggtgggattcgaacccacaacctttgaattgctctattcgtcactagaagtccaatgcgctatccattgcgccacagagccacccgacgaacggcggcgtcttgtagcttacgggtactagagtgggaatggggcagggttggggagcggggctaagggacttgggcgggacatgccaggagggcgcggtttggatctcagaggccaagccaggtagaggtagcgggcgcaaagcatgttagccaggtgagagagagggcgcacatgggtcgaaaaaacagggagggagagcaaccgaaaatggctgagcgagcgagtgcagagctccggctgcccgcttggggggtgtttccggctcaggcgctccccactcccagatatagtcccacccaaataaactagttttgttgtaaatt

SEQ ID NO: 140392 - DNA, 654 bp, Homo sapiens
  Payload ID: 7545
  Gene Symbol: HES7
  Gene Name: hes family bHLH transcription factor 7
  ENST ID: ENST00000577735
  CDS Start-End: 219-654
gaggagcaatggtcacccgggatcgagctgagaatagggacggccccaagggccgccaggtctgagcccggcaccgtgcggcgcacgtgcgtgcgcgcagagagtccccaaagttctccactgagacaaagagaaactgcaccagacggagacgtagagagaaaagaggaggagagacacagagaggggaggagggaggacgagactgagagaggagaatgcgaagatccggggagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccggccgccgcggctccaggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggacc

SEQ ID NO: 140393 - DNA, 2296 bp, Homo sapiens
  Payload ID: 7546
  Gene Symbol: HEY1
  Gene Name: hes-related family bHLH transcription factor with YRPW motif 1
  Uniprot ID: Q9Y5J3
  ENST ID: ENST00000337919
  CDS Start-End: 195-1121
actcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcaggtaatggagcaaggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaa

SEQ ID NO: 140394 - DNA, 2293 bp, Homo sapiens
  Payload ID: 7546
  Gene Symbol: HEY1
  Gene Name: hes-related family bHLH transcription factor with YRPW motif 1
  Uniprot ID: Q9Y5J3
  ENST ID: ENST00000354724
  CDS Start-End: 201-1115
ttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagta

SEQ ID NO: 140395 - DNA, 761 bp, Homo sapiens
  Payload ID: 7546
  Gene Symbol: HEY1
  Gene Name: hes-related family bHLH transcription factor with YRPW motif 1
  ENST ID: ENST00000518733
  CDS Start-End: 204-761
gctgacctccgcgcgtcgcaggctggcggcagcctgcggccagggaacccctaggtgccttccagcccaagtggcaaaaaaagtctgagtgcggggagggtgtgggggcgacctctcagatcacctctcctcgtttaacggcgatttcagtttttgtttgttctttttctcttttcagaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccg

SEQ ID NO: 140396 - DNA, 1325 bp, Homo sapiens
  Payload ID: 7546
  Gene Symbol: HEY1
  Gene Name: hes-related family bHLH transcription factor with YRPW motif 1
  ENST ID: ENST00000523976
  CDS Start-End: 213-857
agtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaaagcatttaaaaacaatatgtggtcttatttttggtatacgggattttaaaaaaaaggtgctgccacatgcctcttgaggaaagaaatgtattctggttaagtaaaggaaacctaacgggagaccaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagat

SEQ ID NO: 140397 - DNA, 2678 bp, Homo sapiens
  Payload ID: 7547
  Gene Symbol: HEY2
  Gene Name: hes-related family bHLH transcription factor with YRPW motif 2
  Uniprot ID: Q9UBP5
  ENST ID: ENST00000368364
  CDS Start-End: 198-1211
gggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 140398 - DNA, 2461 bp, Homo sapiens
  Payload ID: 7547
  Gene Symbol: HEY2
  Gene Name: hes-related family bHLH transcription factor with YRPW motif 2
  ENST ID: ENST00000368365
  CDS Start-End: 119-994
ggaaagttgtgacggtcgagcttgagcctggcgggccgcggagcgttcacctgcggccgggaggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 140399 - DNA, 3661 bp, Homo sapiens
  Payload ID: 7548
  Gene Symbol: HEYL
  Gene Name: hes-related family bHLH transcription factor with YRPW motif-like
  Uniprot ID: Q9NQ87
  ENST ID: ENST00000372852
  CDS Start-End: 321-1307
ctcctggcttccccgcggggcctcccagggcacctgcccaaggccacccagcgcgcggcagccgagacagcggagcagagccggacctcccagccgtcgatgaaggcggcgaccgcctagggccttcccacggctcggcggcgcgtcaccgcgggggcgagggggcgcctgggcgcccggagctgcggcgcaggaaagggccctgggaaagggcggtggcggcgcccccgaggcggggccggggcggggccggggcggggcctgacttcccgactgggagccttagccgcggggctgagaccaggcagcctgcgttcgccatgaagcgacccaaggagccgagcggctccgacggggagtccgacggacccatcgacgtgggccaagagggccagctgagccagatggccaggccgctgtccacccccagctcttcgcagatgcaagccaggaagaaacacagagggatcatagagaaacggcgtcgagaccgcatcaacagtagcctttctgaattgcgacgcttggtccccactgcctttgagaaacagggctcttccaagctggagaaagccgaggtcttgcagatgacggtggatcacttgaaaatgctccatgccactggtgggacaggattctttgatgcccgagccctggcagttgacttccggagcattggttttcgggagtgcctcactgaggtcatcaggtacctgggggtccttgaagggcccagcagccgtgcagaccccgtccggattcgccttctctcccacctcaacagctacgcagccgagatggagccttcgcccacgcccactggccctttggccttccctgcctggccctggtctttcttccatagctgtccagggctgccagccctgagcaaccagctcgccatcctgggaagagtgcccagccctgtcctccccggtgtctcctctcctgcttaccccatcccagccctccgaaccgctccccttcgcagagccacaggcatcatcctgccagcccggaggaatgtgctgcccagtcgaggggcatcttccacccggagggcccgccccctagagaggccagcgacccctgtgcctgtcgcccccagcagcagggctgccaggagcagccacatcgctcccctcctgcagtcttcctccccaacaccccctggtcctacagggtcggctgcttacgtggctgttcccacccccaactcatcctccccagggccagctgggaggccagcgggagccatgctctaccactcctgggtctctgaaatcactgaaatcggggctttctgagctgccccttcaccaccccgccccaaggaataaggaaggttcttttaccaggagcccaaaaaagggcactgccttttctgctttgcttcatggactggctcatatgtgaaggcacgttctccagccatcagaggccccctcctcctccaacccatctctccttctcactgttatcccagcttatccacccagctctcctggagctgttctggtctcagaggcttggttccatttctcacctgaacagatgagtcctgggagagaccctcagagatccgcccagacccctctcctgccctctgcacaccagcagcaggcatgaaccttgggtctgggaaaaagctttaacctgcagggcaccaggacccaaggcaggctgttccttggggcggtcagaccccagtcaggagcaatgactgactggctgcagccttcccacgccaagaggctggaacatagtgtctgcctcgcttcctggagatagtaactgagcaggggctacaaagaggtctcctgggaaccctgtctgccccttcccacctgtccttgggccacaccatcacactgaaccacaggacagaccctttctccaccacagccaaggcctggagactgggggcccagcagagcctgctcccaccctcctcccagcagcagacacccaccctctcactgactaacaggtccctgcacacagctggcctggtaaacccagctgggaggtttctaggcagcagcaaaactctgtgacagggtgtcctcacaccaggccttggacagctctcccagacaggagccagggttgagcaatggagagcccagcccccacgtcttacagtcgccatcctccaggcgtgtggtccctccccattgggtgcacagtgcagaggggccgtggccccatgtgatggtgcgcagagaggaacctcttgggattcagcaccagacgtctgtgctgcctggtttgcatccggctcacagagcccagactgctggaacagccaaggactgtcaggctggacaaaaataactgcaaggaggggcaagagaaaggatgattcgaggcaccttggcccttcaaggtcatgcagtgggtcgagcgcctgagatcctgttcaccaggactccacagagctggctctgctcagaagccatttcattccccggctccaccctaggccactttttctaacagaggaaacaaatggtccagcagtcgttcccagcagaacagcggagcctggactgacacccagtgggaccagtgttgccacaccagttgataaaatgcagaaacccttctgtactcgttggtaaatatctactcccccaagtgactccaggtgccccccaccgcctggcacttcccccaggactcctacgatctggttactgcctggccgatccaaggctgtggagtcccagagccagcagttcactggtgctcattccacactggttagatacttcagttgtcacccctgggaagattctcccacctcctccctttgatggaaccaccctccccagaggctgcattgaggagactccacagactgaaaagtgagtttgcagaaaccttggggaaaagggccctttcaaagaagtggataagagggaggagatcattgagtgacccagaaagctcttttgaaaagacagactcctcaaggagagataaagaggaaagcacctctttcattttttagtgtgagctaattccatcagactgctgtcctcctggacccatctgagatgtgcagtagcaaggagaggggggatcattttagagagtgggtcattggcagggagtgctccggagggaggcagaggggagactgtggtagaaggaagacagaactcacacatgctcccaggattggggacagggacagaggaggtaacagaaggcaaaggccagtttccccgttatcatgaaggggcccactcaggacaggaacaaggacaactcctcctcctcctcctcctctcctgctgctcctgggataccaggtcagtgatgtagtcttgcagtttggcaacttcctagcctgagaatccctagtggggctgtgggaaacacatttccacgttgcaagcatgcaactccaaagaatctgtgatgccactgaaatgagatgggaatgatccagctctttcagcatcttggttgaacttgctttcattgtccctgggatattgtggaaggaaaggtgactgtgtgatctgattctgtggtcaaggacttgcatcttgtgtttctatccccaagccttcctggtgtctccaactcctaccccattgcatgggttgttgcggacatccaataaagatttttttagtgcttctggaaa

SEQ ID NO: 140400 - DNA, 981 bp, Homo sapiens
  Payload ID: 7549
  Gene Symbol: HESX1
  Gene Name: HESX homeobox 1
  Uniprot ID: Q9UBX0
  ENST ID: ENST00000295934
  CDS Start-End: 70-627
cccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaatagactcatgactaagtgattccacaagctggattctaattataaagtatttcaagtaaaataatctgaagaa

SEQ ID NO: 140401 - DNA, 757 bp, Homo sapiens
  Payload ID: 7549
  Gene Symbol: HESX1
  Gene Name: HESX homeobox 1
  ENST ID: ENST00000473921
  CDS Start-End: 21-476
tctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaa

SEQ ID NO: 140402 - DNA, 657 bp, Homo sapiens
  Payload ID: 7549
  Gene Symbol: HESX1
  Gene Name: HESX homeobox 1
  ENST ID: ENST00000495160
  CDS Start-End: 337-657
tttttagtgttacaatctttaaaagttttccccttagattgtttatcagccagtctctctctcccgaagagttctttagtttttgaggaagttgatttggaggcagttcttacaatgagttaagggttcccagttgtgttacagtttctttttccttgatatctcatttctactctgccaacaagaacaccatgcaccccagctctaaagaaggaagactttcaagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtataga

SEQ ID NO: 140403 - DNA, 3938 bp, Homo sapiens
  Payload ID: 7550
  Gene Symbol: HP1BP3
  Gene Name: heterochromatin protein 1, binding protein 3
  Uniprot ID: Q5SSJ5
  ENST ID: ENST00000312239
  CDS Start-End: 141-1802
gttctccgcccccgccgccgccattacggagctcccagtggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctgctgaaccgtagcttata

SEQ ID NO: 140404 - DNA, 928 bp, Homo sapiens
  Payload ID: 7550
  Gene Symbol: HP1BP3
  Gene Name: heterochromatin protein 1, binding protein 3
  Uniprot ID: Q5SSJ5
  ENST ID: ENST00000375000
  CDS Start-End: 228-629
gcggagcgccgaggctcgcgttccgccgctgcttccgtcgccggggcgggcgccgcggtgtccctgccgagcgtgagccccgaactgtcaccgcgccgagccccagcctcatccgtcggtgtccgcggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggta

SEQ ID NO: 140405 - DNA, 4822 bp, Homo sapiens
  Payload ID: 7550
  Gene Symbol: HP1BP3
  Gene Name: heterochromatin protein 1, binding protein 3
  Uniprot ID: Q5SSJ5
  ENST ID: ENST00000375003
  CDS Start-End: 1502-2707
tttttttttttttttgagatggagtcttactctgtcacccaggttggagtgtggagtgcagtggcgcgatctgggctcactgcaacctccacctcccaggttcaagcgattctcctgcctcaacctgccaagtagctgggactacaggcgtgcacctccacacctagctaatttttgtattttcaggagagacgggggtttcaccatgttggccaggatggtctcaatcttttgaccttgtgatccgcccaccttggcctcccaaagtgctgggattacaggcatgagtcaccgcgcccagccaatatgctatatttttgtatgactggcagcactgtaggtttgtttacaccaatgtcaccacaaacaagtgagtaacgtgctgcgctgtgatattaccacagctatcatgttaaccaggtaataggaggttttcagttccattataatcttaagggaccaccattgtatatgtggtctgttgaccaaatattgttacacagcacatgaccataaaagaataacttagtaataactataccttctagctataatcttcagggtattctttatctgagtttcataagtatagctaaggtctgtggaatttatagcaactatcgtgtgtgggtgtgggtgtgtttgtgtgtgtgtgtgtgtgtttaatggagatggcgtctcactatgttggctaggttgggcttgaactcctggcctcaagctgtcctccctcctcagcctcctaaattgctgggattacaggcatgagccactgcacccagcctatcgtctgttgttaaatgttctaatgcacctattaggtgcacagagtactgttatatactcagaataaaatttacataatgctttaaatctcacaaaattgttttgataaacatactcttataattcttgcaacaccttgggaaatagttggttctatattactgttttatagctgaggagaaagactcacatcatttactaagatcatatagctagctagtaaatgtttgagtgaaaatacaaacaaaggttttctgactttaagagcttgagttttttccactataccatattgcatctgttgtaattgttaactaatgtgcattttaaaattctcatttgtcttatgtactgagcccttataccagtgctaatttatgtgactcctttctcctgcagctaagagaaaaatacctttttaattcatttatagtacccagtttttaaagaagatttattttgtaaaattttgcttatggtacatgtcatcttagcctgtaaataaattaaagcattaatttttatccctccctggtcttttcctccttctgactttatacgtctttctagagagcttatcttctataataacaattctttgttttaaagtgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaa

SEQ ID NO: 140406 - DNA, 572 bp, Homo sapiens
  Payload ID: 7550
  Gene Symbol: HP1BP3
  Gene Name: heterochromatin protein 1, binding protein 3
  ENST ID: ENST00000417710
  CDS Start-End: 199-572
gcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaa

SEQ ID NO: 140407 - DNA, 759 bp, Homo sapiens
  Payload ID: 7550
  Gene Symbol: HP1BP3
  Gene Name: heterochromatin protein 1, binding protein 3
  ENST ID: ENST00000419948
  CDS Start-End: 1-759
aaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaat

SEQ ID NO: 140408 - DNA, 538 bp, Homo sapiens
  Payload ID: 7550
  Gene Symbol: HP1BP3
  Gene Name: heterochromatin protein 1, binding protein 3
  ENST ID: ENST00000419490
  CDS Start-End: 419-538
agtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcgaaggtagaagatagcaccatgccgattcgtcgaactgtgaattctacccgggaaactcctcccaaaagcaagcttgctgaaggggaggaagaaaagccagaaccagacataagttcagaggaatctgtctccactgta

SEQ ID NO: 140409 - DNA, 557 bp, Homo sapiens
  Payload ID: 7550
  Gene Symbol: HP1BP3
  Gene Name: heterochromatin protein 1, binding protein 3
  ENST ID: ENST00000443615
  CDS Start-End: 500-557
attacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgagaaggtagaagatagcaccatgccgattcgtcgaactgtgaattctacccgggaaactcctcccaaaagcaagcttg

SEQ ID NO: 140410 - DNA, 473 bp, Homo sapiens
  Payload ID: 7550
  Gene Symbol: HP1BP3
  Gene Name: heterochromatin protein 1, binding protein 3
  ENST ID: ENST00000437575
  CDS Start-End: 339-473
aggggggcggggcggcagagctcggcggctgggactggaggacagcggtggcggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaat

SEQ ID NO: 140411 - DNA, 970 bp, Homo sapiens
  Payload ID: 7550
  Gene Symbol: HP1BP3
  Gene Name: heterochromatin protein 1, binding protein 3
  ENST ID: ENST00000424732
  CDS Start-End: 137-970
gcggcagagctcggcggctgggactggaggacagcggtggcggaggcgactagcggcggcgggagcggcgccgagaggccgtgcgggacgcgggcgccaggaccggccgaacgcagagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacag

SEQ ID NO: 140412 - DNA, 1159 bp, Homo sapiens
  Payload ID: 7550
  Gene Symbol: HP1BP3
  Gene Name: heterochromatin protein 1, binding protein 3
  ENST ID: ENST00000438032
  CDS Start-End: 179-1159
cggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccag

SEQ ID NO: 140413 - DNA, 727 bp, Homo sapiens
  Payload ID: 7550
  Gene Symbol: HP1BP3
  Gene Name: heterochromatin protein 1, binding protein 3
  ENST ID: ENST00000414993
  CDS Start-End: 501-727
agtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctc

SEQ ID NO: 140414 - DNA, 1602 bp, Homo sapiens
  Payload ID: 7551
  Gene Symbol: HNRNPAB
  Gene Name: heterogeneous nuclear ribonucleoprotein A/B
  Uniprot ID: Q99729
  ENST ID: ENST00000355836
  CDS Start-End: 226-1083
cggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaa

SEQ ID NO: 140415 - DNA, 1796 bp, Homo sapiens
  Payload ID: 7551
  Gene Symbol: HNRNPAB
  Gene Name: heterogeneous nuclear ribonucleoprotein A/B
  Uniprot ID: Q99729
  ENST ID: ENST00000358344
  CDS Start-End: 258-1256
aaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 140416 - DNA, 1747 bp, Homo sapiens
  Payload ID: 7551
  Gene Symbol: HNRNPAB
  Gene Name: heterogeneous nuclear ribonucleoprotein A/B
  ENST ID: ENST00000506339
  CDS Start-End: 232-1215
aggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaa

SEQ ID NO: 140417 - DNA, 1595 bp, Homo sapiens
  Payload ID: 7551
  Gene Symbol: HNRNPAB
  Gene Name: heterogeneous nuclear ribonucleoprotein A/B
  ENST ID: ENST00000515193
  CDS Start-End: 221-1063
ccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaa

SEQ ID NO: 140418 - DNA, 1785 bp, Homo sapiens
  Payload ID: 7551
  Gene Symbol: HNRNPAB
  Gene Name: heterogeneous nuclear ribonucleoprotein A/B
  Uniprot ID: Q99729
  ENST ID: ENST00000504898
  CDS Start-End: 268-1266
tcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaa

SEQ ID NO: 140419 - DNA, 1571 bp, Homo sapiens
  Payload ID: 7551
  Gene Symbol: HNRNPAB
  Gene Name: heterogeneous nuclear ribonucleoprotein A/B
  ENST ID: ENST00000514633
  CDS Start-End: 224-1075
gcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggata

SEQ ID NO: 140420 - DNA, 1674 bp, Homo sapiens
  Payload ID: 7551
  Gene Symbol: HNRNPAB
  Gene Name: heterogeneous nuclear ribonucleoprotein A/B
  Uniprot ID: Q99729
  ENST ID: ENST00000506259
  CDS Start-End: 291-1148
gcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaat

SEQ ID NO: 140421 - DNA, 1565 bp, Homo sapiens
  Payload ID: 7551
  Gene Symbol: HNRNPAB
  Gene Name: heterogeneous nuclear ribonucleoprotein A/B
  ENST ID: ENST00000615932
  CDS Start-End: 16-1008
gcgcctcggcctagcatgtcggaagcgggcgaggagcagcccatggagacgacgggcgccaccgagaacggacatgaggccgtccccgaagcgagtcgcggccggggctggacgggcgccgcggcggggctggaggcgcgaccgcggcgcccccgagcgggaatcagaacggcgccgagggaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtggg

SEQ ID NO: 140422 - DNA, 8726 bp, Homo sapiens
  Payload ID: 7552
  Gene Symbol: HNRNPA0
  Gene Name: heterogeneous nuclear ribonucleoprotein A0
  Uniprot ID: Q13151
  ENST ID: ENST00000314940
  CDS Start-End: 311-1228
cgcgttcagcggcctctttgtgtggtgcccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtggatgtttttacacattgaggtaatacatagtcaaatcctttgctctcaaatagttgtacactttccatacatttctgtcttattttttaattctagtgatacacaaattacatgtgggctacttcatttggtaatttggtccagctttttggtggctgtagagtggcctctaggatacagaaaatgattctctgaaatttttcgttgtaattgttaaatactactctgcttgacttactcagttttggtgggaagatctgggtcaattggaatagtacacctttctcagggttttcagtttaataaggttgtcatattattcccaacatgggaatatagtggcttctaaagtttgcaaatgaattatgtaaaaggattttctgtgtattaggaaggcaacctgttctgttcatggtatattaacacttcattgtcatgtgtctacccttaaaattgctatttgtagtgaagaaaaaagcatagtggtatttagtcacttctgggttcctcttgtcagtttatatgcaaacattttggcatgtgggacttggggaggagggacaattggttgtatgttttgaccacttccacctatgaaaattatctgaacattattcagatttaagagttcatgggagcaggtggtacagaacctagtgttgaatataatttttgtgccatgcttgaatgtattttgacggattagcaaaataaaagtgaacctcctatttttcatcttaatgtgaagatctttggcatttacattcttttaaaagtataaattcagtagtcattagttgaaagtggtttgaaaggctgttagagatgatacaggttgagtattccttatctgaaattcttgggcccagaagtgttttgagttttagatttttttcaatttttgaatatttccattatgtttaccagctgagcagctctcatacaaaaatgtaaaatccaaactgcttcaatgagcatttcctttgaatgtcatgtctgcactcaaaaaatttcggattttggagcattttagattttttgattggaatatctgtagtgtttttcaggtcatttaaaaagctctcattggtactgatttactgtatccaaaaaaaagcctgcaagtggttaaggttcacagtgataactatcaaatcagaatgactatactgattgtacccattcatccatttttaacttagtgatttggaacgtttcatattcaaatctaattttcataatttttaagtaaacctaaaagattgaggatacttgagaaatttgcatttatgatttccttcaaaaccagaagtgatggtatcagttattggatttgtaaacttagtttaccttttaagtgtgcttaagttttgagagtttgcattttaggttaaattttgtctgcccgcgtctgctgattgcagataggcatttggatgttggatttggagcagaactgcatctagactacacggattttacccaaaaagacagcacttgcacttaggctaagtgtctttctccatcgtaaccaatttattgaatcactttaagagtgatcattggggaaattttcctcctcagccttattttggccttttgaaacagcaacaaagactgcctagtcaaataactccttagctgtcctgcttttgagtgaacttcatatttgccttgaatgagaatttaaatgttacaaggtaaaacatttattataaaaagatatttgaaagctgctatttaaaaaggaattccaaagtaggaagactagaagggcaattctctattttccacctattttttttactttgatttgaagccagatgatttgaaccttcagagagggaaaggattcaggaagacacctttggtagttattcttaactgtttccttctctattcaggcaggctttctttgtctctttaattcttttaccactttgtatggtttacttaaaaaatctatctgaaatagctatcatttcctgctataaagttctcaagtgtaaacttttgccatttaaacagtgtgcttatttcccagtgtttaccgtcaatttcattgggtgttaggcacctttgtgtaagacagttctataatgtggaggtacacagcagtgagacaaacatggttgctgtcttcatataccttgcgttctggttggaattcaatttattttgaaatgggaattcaatttattttgagatgatgcatcttttcctttacagcattgtgtcacaatctcatattgttcacaccatcaaaattggagttagctccattgtcattgaatgtacattctctgatgaaaattaagactcttttctccttaattgattactttttagaaatcaaaggtgtattttgtctttgatgcttacgttgcaaatgtaatttgcttcatagtgggtatctgatttaatatttcatagcccttaaggacgtaaatttgggcatccaatagaccaaattctgttcctgacacagtcactttctagcactgcgaccttggacaaactggcccgagcctcacttgccttatttgtaaaaaaataggctatggtaatacctgctacataggattgttgggcagattcagtgaaagaatgcatataaagaagggcttactgtagtctctggtacacagtaattttactatatggcccctaatgaagaggtgggacagactagcaaaaggcatacttttatatcttagtacccgagatatgcatggtctttaggctttgctctttacttgctgggtgagcttccatgtggtagttctctaaatcactgctgcttcaactctagtaggagagagatgaattctgctagccatctgtaatgttttaagtatttgttaatattaggaaggtataaataatgtgagtgttgaggagaggtgacttcaggtaggaagaaggatcaagagaggcattgtggagcatataacatttaaccttaaaagataggtcttatagagaaggtgggaggagaaagagggcattttaggtggaggacagataggcagaaacatggagcgtatttggagaagtatgcatattggatgccaaacactaggtacatttacaaatgttctcattgcatcattcagtaaccttcacagataaggttgctaaatctcatgccagaaaagtaactcccaaggacccccagctggtgacatggtagaactgagagttgaatccaagtttgaccaattctagttgtttcgctccttctactaagcttcattgacttccagctaacaaatgtctaatttgtactaagataaaagagagttgtgagaaataaattgagaaaatgaagttggaaccaggttactgaggtctttgagtagtaggctaaggagtttggacttagggtaggcagtaaaagtcattaaaggtttttgagcaacaataatggtagtgaaactaattcacaaagattagtccagtagcactgagtaacataaatggcagtgggggatgtttcaaagtggcaagtttgctaagacaactgatgttaaccaggtaagagaatgagagcatgaacaaagagcaatggaaatagactgacaaagaagttgaggtaagttgtgaaagcataattgacaaatatttggatatatgaagaatgaggaagagagagtagattaatcaaaattactgtgtgagaggatggtgatgccactggtaataggaagagaagatttagagggaagatttggacatagttgaagatgctggtagcacattgaagcattgtgtcttgcgcatatagctttacaaaatggccattgtgctggatattctttttgcccttcctgatctattttccatctttatctctcttgttctgtgttcctgggaggctgacaaataaagaactgcatactctcttttctggctttattcatggtgggtttggacagtgatagaaaagtgaggctgaaatatttgctccttctctttctcatatacttagcaagagattgtgagtggccacagctctgctccagtggccctcttatagctctaggtcttttctggcttctcgtaactgtctcctattgctagattctctagtcccaagaaggttcaaaccttgttgatttgccttaactgtgcccatacccttgtaaatagttccttttattaaaactcttcaataactgaatatactgtggtcatctcttcagtgaaattaaaaaaaaaaacttctttcacattttcttatgacttgatcttcccacaccaccaaacgtgaagatctagctatttgcactaggttactatccctaaattcagtgcctccctgtttcttagtatgtcaagttaaaatttgttactcttctgctgggtgattgtgctggaaatacagaagaaaaagacaaaaatccctgccctcaaagagcttatattttactggggagagacaggcaataagacataatcaattatatggtatgttagaagatgagaagtatagaaaaaattagggtgaggaatggcgattgttgcaagggatgtttgtgaggatagcatactttaaaataggtggtatgggtaggtctctcagaaagtgacatttgagcaaagacttgaaggaaatgtgggagtgagcaatataggtatgggaagagcattctaggtagaggattaggaagagcaaaagccctgaagcaggactgtgtctggcctctgaagaaatgcaaattgttcagggttgttggacctgaaggaagaggaggaaaggaataatgaggccagaggggccagatcatgtagggatttgtaggttgttgtaaggattttggttttcactaaatgaatggtgaaccatttcagttttgagcagaggagttccatgatctgatttgaattttaaaagatgtgtttcccaaaattcctattcctttcatacagctgctttcaatgaaggtttataaggaaagcaatcagaactacttggataaggtataagtgatccacaatcttttcaactctaccataggtatctacatatatatgttgagagatgctgctttttggccaaaatgaatcttgaattgggggtgtgcagaaaaagttatatctggcctgaggctggtatcttttagagtggcctacttgcatggttggcccttatctgaacacgtggatttaggggtattctcactgttcactaataaaggtggttcactgtacctagactgttcaaacaagatgatttatgctaaacacctgctttccttctgggagtatggaattttggtacatgccaggtaaaggatgtctatatgaccaaactcccaatgaaaaccttgcatactgagtccctaggcagaaacatccctcgtataaaaatgtgctctgtgtgaatcttcatgggagggagagatcctaaagaagcctgcacatggattcctccagattctgcttatgtctttttcctgtatgatccaactgtgtacacttactgtgtcactgtaataaactttagccatgagtacgata

SEQ ID NO: 140423 - DNA, 1294 bp, Homo sapiens
  Payload ID: 7553
  Gene Symbol: HNRNPA1
  Gene Name: heterogeneous nuclear ribonucleoprotein A1
  ENST ID: ENST00000330752
  CDS Start-End: 34-957
agcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtattggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaa

SEQ ID NO: 140424 - DNA, 1842 bp, Homo sapiens
  Payload ID: 7553
  Gene Symbol: HNRNPA1
  Gene Name: heterogeneous nuclear ribonucleoprotein A1
  Uniprot ID: P09651
  ENST ID: ENST00000340913
  CDS Start-End: 54-1172
cccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcat

SEQ ID NO: 140425 - DNA, 832 bp, Homo sapiens
  Payload ID: 7553
  Gene Symbol: HNRNPA1
  Gene Name: heterogeneous nuclear ribonucleoprotein A1
  ENST ID: ENST00000550482
  CDS Start-End: 1-576
aaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggaga

SEQ ID NO: 140426 - DNA, 1539 bp, Homo sapiens
  Payload ID: 7553
  Gene Symbol: HNRNPA1
  Gene Name: heterogeneous nuclear ribonucleoprotein A1
  Uniprot ID: P09651
  ENST ID: ENST00000547276
  CDS Start-End: 29-832
cgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaa

SEQ ID NO: 140427 - DNA, 711 bp, Homo sapiens
  Payload ID: 7553
  Gene Symbol: HNRNPA1
  Gene Name: heterogeneous nuclear ribonucleoprotein A1
  ENST ID: ENST00000548688
  CDS Start-End: 18-711
gccaaccatgagttatcatgcgggactcgttactcgtagcaaaattcttaggcacacaggatctttgtctttttttaaaccttgccttgtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtggga

SEQ ID NO: 140428 - DNA, 481 bp, Homo sapiens
  Payload ID: 7553
  Gene Symbol: HNRNPA1
  Gene Name: heterogeneous nuclear ribonucleoprotein A1
  ENST ID: ENST00000551702
  CDS Start-End: 46-481
cgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagag

SEQ ID NO: 140429 - DNA, 530 bp, Homo sapiens
  Payload ID: 7553
  Gene Symbol: HNRNPA1
  Gene Name: heterogeneous nuclear ribonucleoprotein A1
  ENST ID: ENST00000547708
  CDS Start-End: 61-530
ctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggctttggtggcagccgtggtggtggtggatatggtggcagtggggatggctataatggatttggtaatgatggaagcaattttggaggtggtggaagctacaatgattttgggaattacaacaatcagtcttcaaattt

SEQ ID NO: 140430 - DNA, 4121 bp, Homo sapiens
  Payload ID: 7553
  Gene Symbol: HNRNPA1
  Gene Name: heterogeneous nuclear ribonucleoprotein A1
  Uniprot ID: P09651
  ENST ID: ENST00000546500
  CDS Start-End: 616-1578
aaagctaggacaaactcccgccaacacgcaggcgccgtaggttcactgcctactcctgcccgccatttcacgtgttctcagaggcaggtggaacttcttaatgcgcctgcgcaaaactcgccattttactacacgtgcggtcaacaagagttcattgcaaaaaaattgttacctcctggctgcttgtctaatacatagtgttaatcatgctttgccaagcgacttgactgtaatatttgcgcgtggaagattaaaaagatgttaaacacccaaggtagattcaaatgtgaatgattggtcggttggccaatcagactggttaacaataacattactcgggaaccaatggactccaaggggtggagacggcgtagaacgaccgaaggaatgacgttacacagcaatgtggcaccacaggccaatagcagggggaagcgatttcaagtatccaatcagagctgttccagggcggagtctaccaatgccgaaagcgaggaggcggggtaaaaaagagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 140431 - DNA, 569 bp, Homo sapiens
  Payload ID: 7553
  Gene Symbol: HNRNPA1
  Gene Name: heterogeneous nuclear ribonucleoprotein A1
  ENST ID: ENST00000550994
  CDS Start-End: 231-569
agggacgcatgcgcttgcgatttcctagcactcccaactccagcatacggcctcccttgataggcagaagcacgtgtcttgttgcgacctgaacgaacaataagtgctagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactcc

SEQ ID NO: 140432 - DNA, 1234 bp, Homo sapiens
  Payload ID: 7553
  Gene Symbol: HNRNPA1
  Gene Name: heterogeneous nuclear ribonucleoprotein A1
  Uniprot ID: P09651
  ENST ID: ENST00000547566
  CDS Start-End: 61-1023
ctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaacttag

SEQ ID NO: 140433 - DNA, 3011 bp, Homo sapiens
  Payload ID: 7554
  Gene Symbol: HNRNPA1L2
  Gene Name: heterogeneous nuclear ribonucleoprotein A1-like 2
  Uniprot ID: Q32P51
  ENST ID: ENST00000357495
  CDS Start-End: 1708-2670
catagtaccttagttggggagctctgccttatgtcctggtatttcttaagattcctttcttggctctcttcccactgcacatgcttctttgacaatctcatttacttccatggctcagtcacatctgatatccacgtccaatcaatcatgcagcccaggtaatttacctcctcaaaagcttttaatttgtcatttgtcttcatgtttctaccttagtttaagttaccatcatttcttacaaggaatatgcaaacttctgaacagggtttacaaggaccagcatgatctgtcccgatattacatcttgactctctgtagccctaacataatctagtcatcaactcctgaataagacatggctgtcagtacttggcctctccacaccaaatcattgactcaagattgtttattaaagaaggacctgtgatgctgttgtcattgtccttaacctgtaaacttgctgccttcctcactttccatttattctttaaccctctgtagtattgcatttgacttattaccctgaatttgttgttacaaaggtcactaagagtaaccaatttccatattgctgaatcccatccttccttctcttcctggacctcttgatcaattgataacctttcataactcacttttcctctaaactctctattgccttcagttttgcccaatctgaagtgcccaactgtcctatcctgcttctgtaatattttcccccttttaccatgtaaaaaataatttcctgatgttccctttgggttgctccagagactttttcaaagattggagttctcccaagttttgtctaaaggtcactgttcttattctctgttttcaacttgtccgcttccaatctgttctccccagtgcaataggagtgtcagtctaattatgtcaagccttcagtggttttttaaatcttttcagatggagttgaggccctatgtggtctcacctcttctttatctcaccagccttatgatcaaattctgcactcccagacataatagcaattagaataagaatgttttcaattgcaagaagcaaacagaaaaacccaactcaaaattattaaataatacaaaacaaaaagtcaggagtttggaggcttctgggttggttaactcaggagctcactggtatcactgatgaactaggtttctccatccttatgctttcactttccttgggatattggtttggtcttccaggatggctattgctaaaggtagctgcagtaatttattctgtgtttctgtttatcaataaggagacctttcccagaatccctgagcagacacctcatgcatggcccaattggctagattagttatataccccttcttaaaccatattgtttgccaatatggccaacaatgtggggttggtgatcccaacaatgtgggatgtgggattaccacaaatgacttagtcatgtgctggagaaacaaaattagggcttcacagcaaggaagaagggaggaatgaagtatcctactgttatgtatacttgtctttcttcctgtacatacactaaaaaatgttcaggcccatatgaaaaatgtatttatttcccaaagagaatcagccagaatctcatccaaatactctatccagcttcatatctaagatctctggtggactttttctgcccgtggacgccgctgaagaagcatcgttaaagtctctcttcaccttgccgtcatgtctaagtcagcgtctccaaaagagcccgaacagctgaggaagctcttcattggagggttgagctttgaaacaactgatgagagcctgaggagccattttgagcaatggggaacgctcacagactgtgtggtaatgagagatccaaacaccaagcgctccaggggctttgggtttgtcacatatgccactgtggaggaggtggatgcagctatgaatacaacgccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtaattgaaatcatgactgaccgaggcagtggcaagaaaaggggctttgcctttgtaacctttgacgaccatgactccgtggataagattgtcattcagaaataccatactgtgaagggccacaactgtgaagttagaaaagccctgccaaagcaagagatggctagtgcttcatccagccaaagaggtcgaaggggttctggaaactttggtggtggtcgtggagatggtttcggtgggaatgacaactttggtcgtggaggaaacttcagtggtcgtggtggctttggtggcagctgtggtggtggtggatatggtggcagtggggatggctataatggatttggtaatgatggaagcaattttggaggtggtggaagctacaatgattttggcaattacaacaatcagtcttcaaattttggacccatgaagggaggaaattttggaggcagaagctctggcccctatggcggtggaggccaatactttgcaaaaccacaaaaccaaggtggctatggcgtttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagtgttttaatgtagatttttttttttgcacccatgctgttgattgctaaatgtaatagtctgattgtgacgctgaataaatgtctctaaaaaaaaaaaa

SEQ ID NO: 140434 - DNA, 3664 bp, Homo sapiens
  Payload ID: 7555
  Gene Symbol: HNRNPA2B1
  Gene Name: heterogeneous nuclear ribonucleoprotein A2/B1
  Uniprot ID: P22626
  ENST ID: ENST00000354667
  CDS Start-End: 170-1231
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcattatgcactgta

SEQ ID NO: 140435 - DNA, 1711 bp, Homo sapiens
  Payload ID: 7555
  Gene Symbol: HNRNPA2B1
  Gene Name: heterogeneous nuclear ribonucleoprotein A2/B1
  Uniprot ID: P22626
  ENST ID: ENST00000356674
  CDS Start-End: 170-1195
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaa

SEQ ID NO: 140436 - DNA, 1724 bp, Homo sapiens
  Payload ID: 7555
  Gene Symbol: HNRNPA2B1
  Gene Name: heterogeneous nuclear ribonucleoprotein A2/B1
  Uniprot ID: P22626
  ENST ID: ENST00000360787
  CDS Start-End: 170-1231
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatggcattgatatgaaccatggacaagtatattctgctgccacaaagactgtaaagtgcttcatttcaacagctgaggcaagccaagtgatcattaataaagcttttcttggttccttcagtggtgttggtagtaaaatggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaa

SEQ ID NO: 140437 - DNA, 3539 bp, Homo sapiens
  Payload ID: 7555
  Gene Symbol: HNRNPA2B1
  Gene Name: heterogeneous nuclear ribonucleoprotein A2/B1
  ENST ID: ENST00000618183
  CDS Start-End: 217-1002
agtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcatta

SEQ ID NO: 140438 - DNA, 2067 bp, Homo sapiens
  Payload ID: 7556
  Gene Symbol: HNRNPA3
  Gene Name: heterogeneous nuclear ribonucleoprotein A3
  Uniprot ID: P51991
  ENST ID: ENST00000392524
  CDS Start-End: 238-1374
cccctgaaagctggcgaggcgcgcgcgctcccgcggcacgccgcgcctccgccctccgcccgccaacccgctggtccagtccctcttcgcgcccgcttggctccgcccccttcccaattcgctcctcccccaacagactggcggcgcgcggaaaacgcgtcacgtgacgactggccccgcctcttcctctcggtcccatattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaattt

SEQ ID NO: 140439 - DNA, 643 bp, Homo sapiens
  Payload ID: 7556
  Gene Symbol: HNRNPA3
  Gene Name: heterogeneous nuclear ribonucleoprotein A3
  ENST ID: ENST00000432457
  CDS Start-End: 1-348
gggcataattgtgaagtgaaaaaggccctttctaaacaagagatgcagtctgctggatcacagagaggtcgtggaggtggatctggcaattttatgggtcgcggagggaactttggaggtggtggaggtaattttggccgtgatggtggatataatggatttggaggtgatggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttt

SEQ ID NO: 140440 - DNA, 5688 bp, Homo sapiens
  Payload ID: 7556
  Gene Symbol: HNRNPA3
  Gene Name: heterogeneous nuclear ribonucleoprotein A3
  Uniprot ID: P51991
  ENST ID: ENST00000411529
  CDS Start-End: 52-1122
ctctcggtcccatattgaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacacatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgttttggtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagttgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttagtcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttatataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgtgtgtgttgttttgtcacttcacaatgttcatgtgacttaaacactataggtgaatattttgacttattttaccagtaagtaataaaacaacaggaaacttgg

SEQ ID NO: 140441 - DNA, 1731 bp, Homo sapiens
  Payload ID: 7556
  Gene Symbol: HNRNPA3
  Gene Name: heterogeneous nuclear ribonucleoprotein A3
  Uniprot ID: P51991
  ENST ID: ENST00000435711
  CDS Start-End: 29-1165
agttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggtaggtatctttaaatttttattatgatgataaaagaatatgtggaactgttcactgagtgtaataatttttttatcctgtattattcaacaggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaag

SEQ ID NO: 140442 - DNA, 3301 bp, Homo sapiens
  Payload ID: 7557
  Gene Symbol: HNRNPC
  Gene Name: heterogeneous nuclear ribonucleoprotein C (C1/C2)
  ENST ID: ENST00000336053
  CDS Start-End: 234-1100
aataggaagattctcaggaatggggcggggactaggccttcgcctcggcggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagatttcaggaaaatggcgacagctgcataatggaacccccctgcttctattttgttcttttaattactatttatagccccagttaccttctgaattctgaagtgtatatacctccatgttcctgaaaacaagaaaactcttacttcctgatattccatagactgccttcccaggtgattgagaacatagagaatgttacacatttattttactctaaatgatcttttacccctgttagctaatctttgtgttttcctcaactttattaattacagtgattgcatttttagcatccagttgtaagatgaatatattaaacagctaccagtgttggtgatacctcatccttgaaaggcttagttcatttgtgttttatacttcagtttttccagcatagcagaaaatgccgcttataatttttgtgcacacaaaccttggattcccctgtaaagttgctattgtttcatagcatgcggcactggccttttttcatcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcagtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaatggtatgtaaa

SEQ ID NO: 140443 - DNA, 1599 bp, Homo sapiens
  Payload ID: 7557
  Gene Symbol: HNRNPC
  Gene Name: heterogeneous nuclear ribonucleoprotein C (C1/C2)
  ENST ID: ENST00000449098
  CDS Start-End: 53-925
tttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggag

SEQ ID NO: 140444 - DNA, 1559 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000420743
  CDS Start-End: 522-1442
cattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacaccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttct

SEQ ID NO: 140445 - DNA, 4501 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000430246
  CDS Start-End: 2953-3834
ttcttgattgaaaatggtgctaaagttggtctttttatgagtggtagctcttcagtttaacataaataacatcttgggagatactgagctttttgatattgaaagatagaattggtttcttttcacatttttctttatttttaagcttatgtcttgtggcacctgtacaaaggacttggttgtggttgagctataaagttatgtatcttgaaaattgattaccaggtttgggctgtggctccaaataagaaaatgaaatgtttcaccataactgtatttcataaacaggaaaagaacattcagatgtatatttcttacaattcttcacaaactttttccgcaatttgtacattcatacagttttcacacatcaaatgtaaaaattaactgtcattcctacactgttctttttaaaaatgtatggtacttgttgctgctgtagtcattcatgtatagttggctcaaggaacacttctaaaagctcaattaaaaattttttttttgagacagggtctctctctggcctggctgaagtgcagtggcgtgatcagagctcactgcagcctcgaactcctgggctcaagtgatcctcgctcctcagactgctaagtagctgggatttcaggctaccacaccctgctaatgttttttgtttttaataaagtctcgtcatgtttcccaggctggtctcaaactactgagctcaagccgtgctctaccctggcctcccaaagtgttgggattacaggtgtgagccaccacacttggccttaaaatattttaatttcctcaaatttacaaaggagaataagacctcatggctaaattgaacagtgagtgcagctagttcattgtttgcacaaggaactacagtctaattgcagttcctattttagctgatgaaacaaccagtttgtcatggaaattattttagtgtggtattatgtaccagatttttagaatccataacttgaaattagctttacacgctacatagtaaatagtggactacagaaacaaaagtattaacataaggaccttaatttttttcacctattttatgaccttaaatattcagtatttttttaattccatctgtattttcgttttgtcagtgagtggaataatgtgctccttatttaaaacatcttttcccctaacagtagaacctattaggtcttgtggtttgatcactcactggttttgagaatagatgagtcatctctagtatagatcttcatggtaggccattcaccttcagtctattactcatagcaaaaactccacggacttttttaagtttaaaacccatgaatctgcttaggttttataatctcagtatttgacatttgctcactatttcatctctatttgttggcccggtttttctgtattttctttgcccaaactgctcattatcaagatgaacatttgggatatactctttttgagaccctcaagggcatattgacatgaatttagttaattttagtcatctattgatgttgaagaattgtgaagacagtcactggtagaggtgattctatggaggctatcccatcccagtggaatgttaatgctttaccaaaatgtgttagctgcagtagacagatgtttctgtcttgggggtttagggcacaacatttctgaggaactctgactcaatctgtcccttctcctttcacagggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttccccacactgaaaagaattttactggctgttaagtctatgaccttatttttcctgatctttaacttaactgttttagagcatctctggacgtctgtatttttaattttttttatttttgtttttttatttttaatctttcatttgttaaatttttaaactgtgctgcaataaaatgtgtgtggtactacttaacacttatgatcgtgatggcattttccctgaaagccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggag

SEQ ID NO: 140446 - DNA, 644 bp, Homo sapiens
  Payload ID: 7557
  Gene Symbol: HNRNPC
  Gene Name: heterogeneous nuclear ribonucleoprotein C (C1/C2)
  ENST ID: ENST00000554891
  CDS Start-End: 267-644
ggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacagtgtttccagtgtaaatgaattgattctatttattgccttttgaagaaaattatacttaatggttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttac

SEQ ID NO: 140447 - DNA, 1375 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000553300
  CDS Start-End: 208-1089
agaggagactcgggggccattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggttttta

SEQ ID NO: 140448 - DNA, 1790 bp, Homo sapiens
  Payload ID: 7557
  Gene Symbol: HNRNPC
  Gene Name: heterogeneous nuclear ribonucleoprotein C (C1/C2)
  ENST ID: ENST00000553753
  CDS Start-End: 169-1035
tgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaa

SEQ ID NO: 140449 - DNA, 698 bp, Homo sapiens
  Payload ID: 7557
  Gene Symbol: HNRNPC
  Gene Name: heterogeneous nuclear ribonucleoprotein C (C1/C2)
  ENST ID: ENST00000557157
  CDS Start-End: 55-698
attgcatcactgcactccagcttgtatgacagtgagacagtgtcttaaggaaagatgaatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactctta

SEQ ID NO: 140450 - DNA, 1182 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000555883
  CDS Start-End: 140-892
gcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaa

SEQ ID NO: 140451 - DNA, 599 bp, Homo sapiens
  Payload ID: 7557
  Gene Symbol: HNRNPC
  Gene Name: heterogeneous nuclear ribonucleoprotein C (C1/C2)
  ENST ID: ENST00000557768
  CDS Start-End: 437-599
cattttgtgaagagacgaagactgagcggttgtggccgcgttgccgacctccagcagcagtcggcttctctacgcagaacccgggagtaggagactcagaatcgaatctcttctccctccccttcttgcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcg

SEQ ID NO: 140452 - DNA, 1924 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000554969
  CDS Start-End: 354-1235
cattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggtttttt

SEQ ID NO: 140453 - DNA, 1714 bp, Homo sapiens
  Payload ID: 7557
  Gene Symbol: HNRNPC
  Gene Name: heterogeneous nuclear ribonucleoprotein C (C1/C2)
  ENST ID: ENST00000555309
  CDS Start-End: 187-1104
ttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgat

SEQ ID NO: 140454 - DNA, 1252 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000556897
  CDS Start-End: 114-995
gcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgac

SEQ ID NO: 140455 - DNA, 1599 bp, Homo sapiens
  Payload ID: 7557
  Gene Symbol: HNRNPC
  Gene Name: heterogeneous nuclear ribonucleoprotein C (C1/C2)
  ENST ID: ENST00000556142
  CDS Start-End: 163-858
ttttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaa

SEQ ID NO: 140456 - DNA, 1784 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000554455
  CDS Start-End: 191-1111
cattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaa

SEQ ID NO: 140457 - DNA, 629 bp, Homo sapiens
  Payload ID: 7557
  Gene Symbol: HNRNPC
  Gene Name: heterogeneous nuclear ribonucleoprotein C (C1/C2)
  ENST ID: ENST00000556226
  CDS Start-End: 265-629
acgaagactgagcggttgtggccgcgttgccgacctccagcagcagtcggcttctctacgcagaacccgggagtaggagactcagaatcgaatctcttctccctccccttcttgtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgatag

SEQ ID NO: 140458 - DNA, 1156 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000556628
  CDS Start-End: 176-856
cgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaactcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaa

SEQ ID NO: 140459 - DNA, 1658 bp, Homo sapiens
  Payload ID: 7557
  Gene Symbol: HNRNPC
  Gene Name: heterogeneous nuclear ribonucleoprotein C (C1/C2)
  ENST ID: ENST00000555914
  CDS Start-End: 170-1048
ctgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgat

SEQ ID NO: 140460 - DNA, 580 bp, Homo sapiens
  Payload ID: 7557
  Gene Symbol: HNRNPC
  Gene Name: heterogeneous nuclear ribonucleoprotein C (C1/C2)
  ENST ID: ENST00000557336
  CDS Start-End: 382-580
gactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacagaatactagtcaagtgactgaagattgatgtggatttgggagaggagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctg

SEQ ID NO: 140461 - DNA, 1039 bp, Homo sapiens
  Payload ID: 7557
  Gene Symbol: HNRNPC
  Gene Name: heterogeneous nuclear ribonucleoprotein C (C1/C2)
  ENST ID: ENST00000554383
  CDS Start-End: 254-1039
agaggagactcgggggccattttgtgaagagacgaagactgagcggttgtggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcgg

SEQ ID NO: 140462 - DNA, 789 bp, Homo sapiens
  Payload ID: 7557
  Gene Symbol: HNRNPC
  Gene Name: heterogeneous nuclear ribonucleoprotein C (C1/C2)
  ENST ID: ENST00000555137
  CDS Start-End: 265-789
acgaagactgagcggttgtggccgcgttgccgacctccagcagcagtcggcttctctacgcagaacccgggagtaggagactcagaatcgaatctcttctccctccccttcttgtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattct

SEQ ID NO: 140463 - DNA, 781 bp, Homo sapiens
  Payload ID: 7557
  Gene Symbol: HNRNPC
  Gene Name: heterogeneous nuclear ribonucleoprotein C (C1/C2)
  ENST ID: ENST00000555215
  CDS Start-End: 221-781
gaagactgagcggttgtggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaag

SEQ ID NO: 140464 - DNA, 1403 bp, Homo sapiens
  Payload ID: 7557
  Gene Symbol: HNRNPC
  Gene Name: heterogeneous nuclear ribonucleoprotein C (C1/C2)
  ENST ID: ENST00000556513
  CDS Start-End: 354-1049
cattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaa

SEQ ID NO: 140465 - DNA, 1371 bp, Homo sapiens
  Payload ID: 7557
  Gene Symbol: HNRNPC
  Gene Name: heterogeneous nuclear ribonucleoprotein C (C1/C2)
  Uniprot ID: P07910
  ENST ID: ENST00000557201
  CDS Start-End: 165-1085
cattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggttttta

SEQ ID NO: 140466 - DNA, 748 bp, Homo sapiens
  Payload ID: 7557
  Gene Symbol: HNRNPC
  Gene Name: heterogeneous nuclear ribonucleoprotein C (C1/C2)
  ENST ID: ENST00000554539
  CDS Start-End: 209-748
ggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgac

SEQ ID NO: 140467 - DNA, 531 bp, Homo sapiens
  Payload ID: 7557
  Gene Symbol: HNRNPC
  Gene Name: heterogeneous nuclear ribonucleoprotein C (C1/C2)
  ENST ID: ENST00000555176
  CDS Start-End: 180-531
atatataagttagtggaactttgcttgagtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacggg

SEQ ID NO: 140468 - DNA, 1308 bp, Homo sapiens
  Payload ID: 7557
  Gene Symbol: HNRNPC
  Gene Name: heterogeneous nuclear ribonucleoprotein C (C1/C2)
  ENST ID: ENST00000557442
  CDS Start-End: 190-633
attttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgca

SEQ ID NO: 140469 - DNA, 1108 bp, Homo sapiens
  Payload ID: 7558
  Gene Symbol: HNRNPCL1
  Gene Name: heterogeneous nuclear ribonucleoprotein C-like 1
  Uniprot ID: O60812
  ENST ID: ENST00000317869
  CDS Start-End: 227-1108
ctgagctacaactacaaccagaggtctaaactacaaccagatctgaattcttgttgggagccattttgtgaagagacgaagactgagctgttttggctgcatttctggcctcgagccgcagtcagtttctccccgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcggagccaaaagtgaaccgaggaaacgcaggtgtgaaacgatcagcagcggagatgtacggctcctcttttgacttggactatggctttcaacgggattattatgatggaatgtacagtttcccagcacgtgtacctcctcctcctcccattgctctggctgtagtgccctcgaaacgtcaacgtctatcaggaaacacctcacgaaggggcaaaagtggcttcaattctaagagtggaaagcggggatcttccaagtctggaaagttgaaaggtgatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtgaagatggagtctgaggggggtgcagaagactctgctgaggagggggacccactggatgatgatgttaatgaagatcagggggatgaccagctggagttgatcaaggatgatgaaaaagaggctgaggaaggagaggatgacagagacagcaccaatggccaggatgactcttaa

SEQ ID NO: 140470 - DNA, 1156 bp, Homo sapiens
  Payload ID: 7558
  Gene Symbol: HNRNPCL1
  Gene Name: heterogeneous nuclear ribonucleoprotein C-like 1
  Uniprot ID: O60812
  ENST ID: ENST00000617044
  CDS Start-End: 244-1125
cctggagttcctgcttggttcttcctgaggactgagcaccttctagactacatccagatctgaattcttgttgggagccattttgtgaagagacgaagactgagctgttttggctgcatttctggcctcgagccgcagtcagtttctccccgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcggagccaaaagtgaaccgaggaaacgcaggtgtgaaacgatcagcagcggagatgtacggctcctcttttgacttggactatggctttcaacgggattattatgatggaatgtacagtttcccagcacgtgtacctcctcctcctcccattgctctggctgtagtgccctcgaaacgtcaacgtctatcaggaaacacctcacgaaggggcaaaagtggcttcaattctaagagtggaaagcggggatcttccaagtctggaaagttgaaaggtgatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtgaagatggagtctgaggggggtgcagaagactctgctgaggagggggacccactggatgatgatgttaatgaagatcagggggatgaccagctggagttgatcaaggatgatgaaaaagaggctgaggaaggagaggatgacagagacagcaccaatggccaggatgactcttaagcacatagtggggttgagaaatcttatccca

SEQ ID NO: 140471 - DNA, 1108 bp, Homo sapiens; identical to SEQ ID NO: 140469
  Payload ID: 7558
  Gene Symbol: HNRNPCL1
  Gene Name: heterogeneous nuclear ribonucleoprotein C-like 1
  Uniprot ID: O60812
  ENST ID: ENST00000634171
  CDS Start-End: 227-1108

SEQ ID NO: 140472 - DNA, 1156 bp, Homo sapiens; identical to SEQ ID NO: 140470
  Payload ID: 7558
  Gene Symbol: HNRNPCL1
  Gene Name: heterogeneous nuclear ribonucleoprotein C-like 1
  Uniprot ID: O60812
  ENST ID: ENST00000633387
  CDS Start-End: 244-1125

SEQ ID NO: 140473 - DNA, 1148 bp, Homo sapiens
  Payload ID: 7559
  Gene Symbol: HNRNPCL2
  Gene Name: heterogeneous nuclear ribonucleoprotein C-like 2
  Uniprot ID: B2RXH8
  ENST ID: ENST00000621994
  CDS Start-End: 244-1125
cctggagttcctgcttggctcttcctgaggtctgagcaccttctaaactacaaccagatctgaattcttgttggcagccattttgtgaagagacgaagactgagctgttttggctgcatttctggcctcgagccgcagtcagtttctccccgtagaacccggcagtaggagacttagaatcgaatctcttctccctcccgcctcctgtttttggctttttgagaaaccttatcatccaacacaatggccagcaacgttaccaacaagatggatcctcactccgtgaactcccgtgtgttcattgggaatctcaacactcttgttgtcaagaaatctgatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgcagttattaacctggctgcagagccaaaagtgaaccgaggaaacgcaggtgtgaaacgatccgcagcggagatgtacggctcctcttttgacttggactatggctttcaacgggattattatgatgggatgtacagtttcccagcacgtgtacctcctcctcctcccattgctctggctgtagtgccctcgaaacgccagcgcatatcaggaaacacctcacgaaggggcaaaagtggcttcaattctaagagtggaaagcggggatcttccaagtctggaaagctgaaaggagatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtaaagatggagtctgaggggggtgcagaagactctgctgaggagggggacccactggatgatgatgataatgaagatcagggggacaaccagcttcatttgatcaagaataatgaaaaagatgctgaggaaggagaggataacagagacagcaccaatggccaggatgactcttaagcacatagtggggttgagaaatc

SEQ ID NO: 140474 - DNA, 1148 bp, Homo sapiens
  Payload ID: 7559
  Gene Symbol: HNRNPCL2
  Gene Name: heterogeneous nuclear ribonucleoprotein C-like 2
  ENST ID: ENST00000619361
  CDS Start-End: 244-1125
cctggagttcctgcttggctcttcctgaggtctgagcaccttctaaactacaaccagatctgaattcttgttggcagccattttgtgaagagacgaagactgagctgttttggctgcatttctggcctcgagccgcagtcagcttctccccgtagaacccggcagtaggagacttagaatcgaatctcttctccctcccgcctcctgtttttggctttttgagaaaccttatcatccaacacaatggccagcaacgttaccaacaagatggatcctcactccgtgaactcccgtgtgttcattgggaatctcaacactcttgttgtcaagaaatctgatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgcagttattaacctggctgcagagccaaaagtgaaccgaggaaacgcaggtgtgaaacgatccgcagcggagatgtacggctcctcttttgacttggactatggctttcaacgggattattatgatgggatgtacagtttcccagcacgtgtacctcctcctcctcccattgctctggctgtagtgccctcgaaacaccagcgcatatcaggaaacacctcacgaaggggcaaaagtggcttcaattctaagagtggaaagcggggatcttccaagtctggaaagctgaaaggagatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtaaagatggagtctgaggggggtgcagaagactctgctgaggagggggacccactggatgatgatgataatgaagatcagggggacaaccagcttcatttgatcaagaataatgaaaaagatgctgaggaaggagaggataacagagacagcaccaatggccaggatgactcttaagcacatagtggggttgagaaatc

SEQ ID NO: 140475 - DNA, 1148 bp, Homo sapiens; identical to SEQ ID NO: 140473
  Payload ID: 7559
  Gene Symbol: HNRNPCL2
  Gene Name: Heterogeneous nuclear ribonucleoprotein C-like 2
  ENST ID: ENST00000633810
  CDS Start-End: 244-1125

SEQ ID NO: 140476 - DNA, 1148 bp, Homo sapiens
  Payload ID: 7560
  Gene Symbol: HNRNPCL3
  Gene Name: heterogeneous nuclear ribonucleoprotein C-like 3
  Uniprot ID: B7ZW38
  ENST ID: ENST00000617807
  CDS Start-End: 244-1125
cctggagttcctgcttggttcttcctgaggtctgaacaccctgcaaactgagcccagatctgaattcttgttgggagccattttgtgaagagacgaagactgagctggtttggctgcatttctggcctcgagccgcagtcagcttctccacgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcagagccaaaagtgaaccgaggaaacgcaggtgtgaaacgatcagcagcagagatgtacggctcctcttttgacttggactataacttgcaacgggattattatggtgggatgtacagtttcccagcacgtgtacctcctcctcctcccattgctctggctgtagtgccctcgaaacgccagcgcatatcaggaaacacctcacgaaggggcaaaagtggcttcaattctaagagtggaaagcggggatcttccaagtctggaaagctgaaaggagatgaccttcaggccattaagcaggagttgacccagataaaacagaaagtggattctctcctggaaaacctggaaaaaattgaaaaggaacattgcaagcaaggagtagaggtaaagaatgctaagtctgaagaggagcagaccagcagctcctcgaagaaggataagactcacgtgaagatggagtctgaggggggtgcagatgactctgttgaggagggggacctactgtgtgatgatgataatgaagatcagggggacaaccagctggagttgatcaaggatgatgaaaaaggggctgaggaaggagaggatgacagagacagggcgaatggccaggatgactcttaagcacatagtggggttgagaaatc

SEQ ID NO: 140477 - DNA, 1148 bp, Homo sapiens; identical to SEQ ID NO: 140476
  Payload ID: 7560
  Gene Symbol: HNRNPCL3
  Gene Name: Heterogeneous nuclear ribonucleoprotein C-like 3
  ENST ID: ENST00000633863
  CDS Start-End: 244-1125

SEQ ID NO: 140478 - DNA, 1148 bp, Homo sapiens
  Payload ID: 7561
  Gene Symbol: HNRNPCL4
  Gene Name: heterogeneous nuclear ribonucleoprotein C-like 4
  ENST ID: ENST00000613240
  CDS Start-End: 244-1125
cctggagttcctgcttggttcttcctgaggtctgaacaccctgcaaactgagcccagatctgaattcttgttgggagccattttgtgaagagacgaagactgagctggtttggctgcatttctggcctcgagccgcagtcagcttctccacgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcagagccaaaagtgaaccgaggaaacgcaggtgtgaaacgatcagcagcagagatgtacggctcctcttttgacttggactataacttgcaacgggattattatggtgggatgtacagtttcccagcacgtgtacctcctcctcctcccattgctctggctgtagtgccctcgaaacgccagcgcatatcaggaaacacctcacgaaggggcaaaagtggcttcaattctaagagtggaaagcggggatcttccaagtctggaaagctgaaaggagatgaccttcaggccattaagcaggagttgacccagataaaacagaaagtggattctctcctggaaaacctggaaaaaattgaaaaggaacattgcaagcaaggagtagaggtaaagaatgctaagtctgaagaggagcagaccagcagctcctcgaagaaggataagactcacgtgaagatggagtctgaggggggtgcagatgactctgttgaggagggggacctactgtgtgatgatgataatgaagatcagggggacaaccagctggagttgatcaaggatgatgaaaaaggggttgaggaaggagaggatgacagagacagggcgaatggccaggatgactcttaagcacatagtggggttgagaaatc

SEQ ID NO: 140479 - DNA, 882 bp, Homo sapiens
  Payload ID: 7561
  Gene Symbol: HNRNPCL4
  Gene Name: heterogeneous nuclear ribonucleoprotein C-like 4
  Uniprot ID: P0DMR1
  ENST ID: ENST00000323770
  CDS Start-End: 1-882
atggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcagagccaaaagtgaaccgaggaaacgcaggtgtgaaacgatcagcagcagagatgtacggctcctcttttgacttggactataacctgcaacgggattattatggtgggatgtacagtttcccagcacgtgtacctcctcctcctcccattgctctggctgtagtgccctcgaaacgccagcgcatatcaggaaacacctcacgaaggggcaaaagtggcttcaattctaagagtggaaagcggggatcttccaagtctggaaagctgaaaggagatgaccttcaggccattaagcaggagttgacccagataaaacagaaagtggattctctcctggaaaacctggaaaaaattgaaaaggaacattgcaagcaaggagtagaggtaaagaatgctaagtctgaagaggagcagaccagcagctcctcgaagaaggataagactcacgtgaagatggagtctgaggggggtgcagatgactctgttgaggagggggacctactgtgtgatgatgataatgaagatcagggggacaaccagctggagttgatcaaggatgatgaaaaaggggctgaggaaggagaggatgacagagacagggcgaatggccaggatgactcttaa

SEQ ID NO: 140480 - DNA, 882 bp, Homo sapiens; identical to SEQ ID NO: 140479
  Payload ID: 7561
  Gene Symbol: HNRNPCL4
  Gene Name: Heterogeneous nuclear ribonucleoprotein C-like 4
  ENST ID: ENST00000633805
  CDS Start-End: 1-882

SEQ ID NO: 140481 - DNA, 1667 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENST ID: ENST00000352301
  CDS Start-End: 306-1316
ttttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 140482 - DNA, 3033 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENST ID: ENST00000313899
  CDS Start-End: 279-1346
aaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagtttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagaga

SEQ ID NO: 140483 - DNA, 1585 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  Uniprot ID: Q14103
  ENST ID: ENST00000353341
  CDS Start-End: 309-1229
ccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaa

SEQ ID NO: 140484 - DNA, 782 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000509263
  CDS Start-End: 1-782
agccgccaggattttttcccgcctgtcgtgggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatgg

SEQ ID NO: 140485 - DNA, 748 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000507010
  CDS Start-End: 86-748
tgtgcaacgcggagcgtgagaggaagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataag

SEQ ID NO: 140486 - DNA, 607 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000503822
  CDS Start-End: 143-607
ttaaaggcccccaaggctgtgcaacgcggagcgtgagaggaagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagcc

SEQ ID NO: 140487 - DNA, 1240 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000513584
  CDS Start-End: 314-574
gtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatct

SEQ ID NO: 140488 - DNA, 583 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000509107
  CDS Start-End: 308-583
cattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcgggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaagg

SEQ ID NO: 140489 - DNA, 1089 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000514671
  CDS Start-End: 1-631
gaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacagcgggaacttcattgcaggccctgtgtcgcgctgacttcacgattctcacaggcccgctcaatgcggacagggtacgagatgctcacgctctcgaatgctgccgtttggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 140490 - DNA, 545 bp, Homo sapiens
  Payload ID: 7562
  Gene Symbol: HNRNPD
  Gene Name: heterogeneous nuclear ribonucleoprotein D (AU-rich element RNA binding protein 1, 37kDa)
  ENST ID: ENST00000515432
  CDS Start-End: 211-545
gacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatc

SEQ ID NO: 140491 - DNA, 3781 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000295470
  CDS Start-End: 177-1439
ccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgcta

SEQ ID NO: 140492 - DNA, 1402 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000349655
  CDS Start-End: 115-1020
cgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 140493 - DNA, 2356 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000502762
  CDS Start-End: 712-1974
cgagcgggagaggcccggggcacgtgcagaaaggagccccgcgagtggcgcgccggggatgtgagtgccccttgccctctactgaatccagccccctccccgcccaccgcctccgcctttgcatagatacagtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 140494 - DNA, 1291 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000602300
  CDS Start-End: 109-1014
gatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 140495 - DNA, 1143 bp, Homo sapiens
  Payload ID: 7563
  Gene Symbol: HNRNPDL
  Gene Name: heterogeneous nuclear ribonucleoprotein D-like
  ENST ID: ENST00000514511
  CDS Start-End: 93-266
attttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcataca

SEQ ID NO: 140496 - DNA, 3968 bp, Homo sapiens
  Payload ID: 7563
  Gene Symbol: HNRNPDL
  Gene Name: heterogeneous nuclear ribonucleoprotein D-like
  ENST ID: ENST00000614627
  CDS Start-End: 536-1627
gaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgct

SEQ ID NO: 140497 - DNA, 2404 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000507721
  CDS Start-End: 65-970
cgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattg

SEQ ID NO: 140498 - DNA, 4139 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000621267
  CDS Start-End: 536-1798
gaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgct

SEQ ID NO: 140499 - DNA, 1318 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000630827
  CDS Start-End: 138-1043
agcgggagaggcccggggcacgtgcagaaaggagccccgcgagtggcgcgccggggatctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatg

SEQ ID NO: 140500 - DNA, 1433 bp, Homo sapiens
  Payload ID: 7563
  Gene Symbol: HNRNPDL
  Gene Name: heterogeneous nuclear ribonucleoprotein D-like
  Uniprot ID: O14979
  ENST ID: ENST00000630114
  CDS Start-End: 147-1052
ggttgagcgagcgggagaggcccggggcacgtgcagaaaggagccccgcgagtggcgcgccggggatctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgt

SEQ ID NO: 140501 - DNA, 2186 bp, Homo sapiens
  Payload ID: 7564
  Gene Symbol: HNRNPF
  Gene Name: heterogeneous nuclear ribonucleoprotein F
  Uniprot ID: P52597
  ENST ID: ENST00000337970
  CDS Start-End: 324-1571
gtcgtggaagcaggactgcgccgcgtcttcctcaaggtggggttcggggggccaccgaatcgctgtcacgccggcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaa

SEQ ID NO: 140502 - DNA, 2670 bp, Homo sapiens
  Payload ID: 7564
  Gene Symbol: HNRNPF
  Gene Name: heterogeneous nuclear ribonucleoprotein F
  Uniprot ID: P52597
  ENST ID: ENST00000356053
  CDS Start-End: 403-1650
gctcgcaggcgggggtttccatggtgatggtcaacaagcctcaactgcctctgctacaactgccaagttccccgcgtcccaccctcctctaggtgctccaagggaccaccggggtgcctgatatgagagcgggagtgtagagactcggaggccgaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 140503 - DNA, 2617 bp, Homo sapiens
  Payload ID: 7564
  Gene Symbol: HNRNPF
  Gene Name: heterogeneous nuclear ribonucleoprotein F
  Uniprot ID: P52597
  ENST ID: ENST00000357065
  CDS Start-End: 350-1597
cggttcccgtagccttagctctcggccccgggccctttttcctcctcggctgcgccgcgtgtcctcggagcgcggtccctgtattggtctcctgctcctagaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 140504 - DNA, 2755 bp, Homo sapiens
  Payload ID: 7564
  Gene Symbol: HNRNPF
  Gene Name: heterogeneous nuclear ribonucleoprotein F
  Uniprot ID: P52597
  ENST ID: ENST00000443950
  CDS Start-End: 488-1735
cgccgctcgctccgccccccgcccggaagctcccgcccgagcccgcgcaggccctggggccgaccttcctgccgggccgggcggtccgaggctgctggagtgccgtgagcaggccgcgggaacgtcgccgtcaccttgtctcggggcctcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 140505 - DNA, 2676 bp, Homo sapiens
  Payload ID: 7564
  Gene Symbol: HNRNPF
  Gene Name: heterogeneous nuclear ribonucleoprotein F
  Uniprot ID: P52597
  ENST ID: ENST00000544000
  CDS Start-End: 409-1656
acgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggttgagaacaaaaacatgcacctggagtttccccggagccctctgcgtggttgagcttcggtggaatttcggggctcttggctgccagccgcgcttgcctggtagcaacagaaaccagtcctgctcgcctccgtggacatttcattaccatccagaagtgtctcccactgaaggcatccgtggttgtttttaagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaactttt

SEQ ID NO: 140506 - DNA, 2114 bp, Homo sapiens
  Payload ID: 7565
  Gene Symbol: HNRNPH1
  Gene Name: heterogeneous nuclear ribonucleoprotein H1 (H)
  ENST ID: ENST00000329433
  CDS Start-End: 36-1454
gcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaact

SEQ ID NO: 140507 - DNA, 3667 bp, Homo sapiens
  Payload ID: 7565
  Gene Symbol: HNRNPH1
  Gene Name: heterogeneous nuclear ribonucleoprotein H1 (H)
  Uniprot ID: P31943
  ENST ID: ENST00000356731
  CDS Start-End: 1537-2886
gtgctgctagaaaccacgaacattagtcatctcgcagcatgtgtgcacatggggtgacccgggggcctcctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtaaggggaagtggaggcacacagggctgggacgtgccccaggcaccatacgggtggcttcgggcgcgggacgtccgcagccccgcagctcccaggacgttcgacaatctgcagctgaccagcttcggccggtttggggataaagggaagacaggcggcgcggggagtgggaacgcctgaaggccgcgcccctcctttcaggtcggccaggagcgcgccggtaagagcctgggggcaaggggtagaaagacgcccacctcatcacaacccagagctcgggactcctatacagtcccatagggaacaggcggccgccattcccctcccccacgctggcgggtaaggctagagaacggtttcaaggaagacgcatgcgcatgaaataattataaaccgctaggactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 140508 - DNA, 2279 bp, Homo sapiens
  Payload ID: 7565
  Gene Symbol: HNRNPH1
  Gene Name: heterogeneous nuclear ribonucleoprotein H1 (H)
  Uniprot ID: P31943
  ENST ID: ENST00000393432
  CDS Start-End: 148-1497
acaagggaccttatttaggttgcgcaggcgcccgctggccatttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgca

SEQ ID NO: 140509 - DNA, 2248 bp, Homo sapiens
  Payload ID: 7565
  Gene Symbol: HNRNPH1
  Gene Name: heterogeneous nuclear ribonucleoprotein H1 (H)
  Uniprot ID: P31943
  ENST ID: ENST00000442819
  CDS Start-End: 118-1467
gcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 140510 - DNA, 602 bp, Homo sapiens
  Payload ID: 7565
  Gene Symbol: HNRNPH1
  Gene Name: heterogeneous nuclear ribonucleoprotein H1 (H)
  ENST ID: ENST00000506721
  CDS Start-End: 90-602
atttcgtcttagccacgcagaagtcgcgtgtctagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggtccttatgacagacctggggctggtagag

SEQ ID NO: 140511 - DNA, 850 bp, Homo sapiens
  Payload ID: 7565
  Gene Symbol: HNRNPH1
  Gene Name: heterogeneous nuclear ribonucleoprotein H1 (H)
  ENST ID: ENST00000515158
  CDS Start-End: 459-850
agggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccgggtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttctt

SEQ ID NO: 140512 - DNA, 792 bp, Homo sapiens
  Payload ID: 7565
  Gene Symbol: HNRNPH1
  Gene Name: heterogeneous nuclear ribonucleoprotein H1 (H)
  ENST ID: ENST00000504779
  CDS Start-End: 67-189
atttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgcgttggtaacggaaagcgacctgtaaaacaagaaccaagtacgctggaagccgccttgcagggggcaacactgggtttggcttcagctgtgcaacttggagcattttagcttggtaacactgatcccctttcagactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatga

SEQ ID NO: 140513 - DNA, 620 bp, Homo sapiens
  Payload ID: 7565
  Gene Symbol: HNRNPH1
  Gene Name: heterogeneous nuclear ribonucleoprotein H1 (H)
  ENST ID: ENST00000510431
  CDS Start-End: 136-620
atttaggttgcgcaggcgcccgctggccatttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggt

SEQ ID NO: 140514 - DNA, 1155 bp, Homo sapiens
  Payload ID: 7565
  Gene Symbol: HNRNPH1
  Gene Name: heterogeneous nuclear ribonucleoprotein H1 (H)
  ENST ID: ENST00000505811
  CDS Start-End: 520-1155
acgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtaaggggaagtggaggcacacagggctgggacgtgccccaggcaccatacgggtggcttcgggcgcgggacgtccgcagccccgcagctcccaggacgttcgacaatctgcagctgaccagcttcggccggtttggggataaagggaagacaggcggcgcggggagtgggaacgcctgaaggccgcgcccctcctttcaggtcggccaggagcgcgccgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacaga

SEQ ID NO: 140515 - DNA, 690 bp, Homo sapiens
  Payload ID: 7565
  Gene Symbol: HNRNPH1
  Gene Name: heterogeneous nuclear ribonucleoprotein H1 (H)
  ENST ID: ENST00000515714
  CDS Start-End: 438-690
acgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtcggccaggagcgcgccggtaagagcctgggggcaaggggtagaaagacgcccacctcatcacaacccagagctcgggactcctatacagtcccatagggaacaggcggccgccattcccctcccccacgctggcggtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaag

SEQ ID NO: 140516 - DNA, 610 bp, Homo sapiens
  Payload ID: 7565
  Gene Symbol: HNRNPH1
  Gene Name: heterogeneous nuclear ribonucleoprotein H1 (H)
  ENST ID: ENST00000508103
  CDS Start-End: 95-610
atttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggtccttatgacagacctggggctggtagagggt

SEQ ID NO: 140517 - DNA, 1996 bp, Homo sapiens
  Payload ID: 7565
  Gene Symbol: HNRNPH1
  Gene Name: heterogeneous nuclear ribonucleoprotein H1 (H)
  ENST ID: ENST00000510678
  CDS Start-End: 37-591
tgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatgcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaact

SEQ ID NO: 140518 - DNA, 2105 bp, Homo sapiens
  Payload ID: 7565
  Gene Symbol: HNRNPH1
  Gene Name: heterogeneous nuclear ribonucleoprotein H1 (H)
  ENST ID: ENST00000510411
  CDS Start-End: 37-1326
tgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaact

SEQ ID NO: 140519 - DNA, 805 bp, Homo sapiens
  Payload ID: 7565
  Gene Symbol: HNRNPH1
  Gene Name: heterogeneous nuclear ribonucleoprotein H1 (H)
  ENST ID: ENST00000513225
  CDS Start-End: 316-805
ctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaa

SEQ ID NO: 140520 - DNA, 569 bp, Homo sapiens
  Payload ID: 7565
  Gene Symbol: HNRNPH1
  Gene Name: heterogeneous nuclear ribonucleoprotein H1 (H)
  ENST ID: ENST00000503664
  CDS Start-End: 422-569
ctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcagctgaccagcttcggccggtttggggataaagggaagacaggcggcgcggggagtgggaacgcctgaaggccgcgcccctcctttcaggtcggccaggagcgcgccgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagag

SEQ ID NO: 140521 - DNA, 501 bp, Homo sapiens
  Payload ID: 7565
  Gene Symbol: HNRNPH1
  Gene Name: heterogeneous nuclear ribonucleoprotein H1 (H)
  ENST ID: ENST00000512273
  CDS Start-End: 127-249
agggtgcgaattcgttaggcaaaagctgggtacaggcgcgagccacaggcacggaaacctcgcgccgaccggggccctaggcccgacgacggcagtttgtttcgacgccggaccgcgtaagagacgatgatgttgggcacggaaggtggagagggattcgtggtgaaggtccggggcttgccctggtcttgctcggccgatgaagtgcagaggtttttttctgcgttggtaacggaaagcgacctgtaaaacaagaaccaagtacgctggaagccgccttgcagggggcaacactgggtttggcttcagctgtgcaacttggagcattttagcttggtaacactgatcccctttcagactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacaca

SEQ ID NO: 140522 - DNA, 594 bp, Homo sapiens
  Payload ID: 7565
  Gene Symbol: HNRNPH1
  Gene Name: heterogeneous nuclear ribonucleoprotein H1 (H)
  ENST ID: ENST00000504348
  CDS Start-End: 91-594
catttcgtcttagccacgcagaagtcgcgtgtctagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggct

SEQ ID NO: 140523 - DNA, 559 bp, Homo sapiens
  Payload ID: 7565
  Gene Symbol: HNRNPH1
  Gene Name: heterogeneous nuclear ribonucleoprotein H1 (H)
  ENST ID: ENST00000503105
  CDS Start-End: 68-559
catttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggaatgtctgatcacagatacggggatggtggctctactttccagagcacaacaggacactgtgtacacatgcggggattaccttacagagctact

SEQ ID NO: 140524 - DNA, 885 bp, Homo sapiens
  Payload ID: 7565
  Gene Symbol: HNRNPH1
  Gene Name: heterogeneous nuclear ribonucleoprotein H1 (H)
  ENST ID: ENST00000519958
  CDS Start-End: 1-396
agtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtcaaaccagtccagctacgggggcccagccagccagcagctgagtgggggttacggaggcggctacggtggccagagcagcatgagtggatacgaccaagttttacaggaaaactccagtgattttcaat

SEQ ID NO: 140525 - DNA, 1563 bp, Homo sapiens
  Payload ID: 7565
  Gene Symbol: HNRNPH1
  Gene Name: heterogeneous nuclear ribonucleoprotein H1 (H)
  ENST ID: ENST00000523137
  CDS Start-End: 1066-1563
gtgctgctagaaaccacgaacattagtcatctcgcagcatgtgtgcacatggggtgacccgggggcctcctcgaatgcagcgtctacgcctggtgaatggacgcactcttaccaattctgctctgggagatgcagcggtaacctaccgagcgcagaggccggcgcgcacccgtggagcccgcgctcgcgatccctcctcgtgccagggccccagggcagtcaaggcctgccgaccgttaggcgggtcaaggggtacacagggtgcgaattcgttaggcaaaagctgggtacaggcgcgagccacaggcacggaaacctcgcgccgaccggggccctaggcccgacgacggcaggtaaggggaagtggaggcacacagggctgggacgtgccccaggcaccatacgggtggcttcgggcgcgggacgtccgcagccccgcagctcccaggacgttcgacaatctgcagctgaccagcttcggccggtttggggataaagggaagacaggcggcgcggggagtgggaacgcctgaaggccgcgcccctcctttcaggtcggccaggagcgcgccggtaagagcctgggggcaaggggtagaaagacgcccacctcatcacaacccagagctcgggactcctatacagtcccatagggaacaggcggccgccattcccctcccccacgctggcgggtaaggctagagaacggtttcaaggaagacgcatgcgcatgaaataattataaaccgctaggactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggg

SEQ ID NO: 140526 - DNA, 831 bp, Homo sapiens
  Payload ID: 7565
  Gene Symbol: HNRNPH1
  Gene Name: heterogeneous nuclear ribonucleoprotein H1 (H)
  ENST ID: ENST00000521173
  CDS Start-End: 1-831
tggctttgtacggcttagaggacttccctttggatgtagcaaggaagaaattgttcagttcttctcaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgt

SEQ ID NO: 140527 - DNA, 492 bp, Homo sapiens
  Payload ID: 7565
  Gene Symbol: HNRNPH1
  Gene Name: heterogeneous nuclear ribonucleoprotein H1 (H)
  ENST ID: ENST00000522256
  CDS Start-End: 408-492
ctttcattttcagccctgctctttaaatactagacataccgtctggcgcatgtcgaggcgtgtattattttgatccagtgcgcgtgccgtatgtgacttggcttggcttcccctgaaagcagcggctgtggggagttgattcggaagtgaagggccctgggcgacccggcgagtagaggcaacaccaacactcctccttagcgaggggtctccccgccgcggtggctgcccggccccaaggacaggagggatttgtgcactgactcctgaccccgtcctccagcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcaga

SEQ ID NO: 140528 - DNA, 584 bp, Homo sapiens
  Payload ID: 7565
  Gene Symbol: HNRNPH1
  Gene Name: heterogeneous nuclear ribonucleoprotein H1 (H)
  ENST ID: ENST00000523921
  CDS Start-End: 1-584
agtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttatggtagccaaatgatgggaggcatggg

SEQ ID NO: 140529 - DNA, 832 bp, Homo sapiens
  Payload ID: 7565
  Gene Symbol: HNRNPH1
  Gene Name: heterogeneous nuclear ribonucleoprotein H1 (H)
  ENST ID: ENST00000519033
  CDS Start-End: 1-558
gattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacggtagccaaatgctaggaggcatgggtttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggccca

SEQ ID NO: 140530 - DNA, 806 bp, Homo sapiens
  Payload ID: 7565
  Gene Symbol: HNRNPH1
  Gene Name: heterogeneous nuclear ribonucleoprotein H1 (H)
  ENST ID: ENST00000521116
  CDS Start-End: 461-806
agtcccggttccccgccatcagcacgacctgtgtgagagcacagggtatctgggcagaaggaaaactaggggagcctcatccagcgctggagatggagaagctttgggcttctcgacggcgaggcacccggggaacggggagtcacttagaacctcaaagtagcctcgggcgagaacaagcgaagcaattccaagctctaccaggtcacggagggcgcgaaacccgccccgcgctccggccggccggcagggggcgcgcgctccccgaactcccgcgcaccgcggaggaggcggccctggcgcggggaagcagtgggaaaatcgcaaggaagccggcgctgctctgaagggagagtctgtgcagtggcacctgcgcgaagctggccaaagcctgcccagacggctcacctgtgcgggatggaacaaaagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggctta

SEQ ID NO: 140531 - DNA, 793 bp, Homo sapiens
  Payload ID: 7565
  Gene Symbol: HNRNPH1
  Gene Name: heterogeneous nuclear ribonucleoprotein H1 (H)
  ENST ID: ENST00000523449
  CDS Start-End: 1-352
agcagatgtcgagttcgcaactcatgaagatgctgtggcagctatgtcaaaagacaaagcaaatatgcaacacagatatgtagaactcttcttgaattctacagcaggagcaagcggtgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccac

SEQ ID NO: 140532 - DNA, 549 bp, Homo sapiens
  Payload ID: 7565
  Gene Symbol: HNRNPH1
  Gene Name: heterogeneous nuclear ribonucleoprotein H1 (H)
  ENST ID: ENST00000521790
  CDS Start-End: 249-549
aggcttcacaagttatgtaatttgtagtggggacatggaatagacatttcatctgtgtcacccagaggtggttttaggttttaaattctgtattaacggttgttttctttccagactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggc

SEQ ID NO: 140533 - DNA, 143 bp, Homo sapiens
  Payload ID: 7565
  Gene Symbol: HNRNPH1
  Gene Name: heterogeneous nuclear ribonucleoprotein H1 (H)
  ENST ID: ENST00000523136
  CDS Start-End: 1-143
agcaggagcaagcggtggtgcttatggtagccaaatgatgggaggcatgggcttgtgtaaatatccaaaccagtccagctacgggggcccagccagccagcagctgagtgggggttacggaggcggctacggtggccagagca

SEQ ID NO: 140534 - DNA, 530 bp, Homo sapiens
  Payload ID: 7565
  Gene Symbol: HNRNPH1
  Gene Name: heterogeneous nuclear ribonucleoprotein H1 (H)
  ENST ID: ENST00000519056
  CDS Start-End: 66-530
tttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggcca

SEQ ID NO: 140535 - DNA, 123 bp, Homo sapiens
  Payload ID: 7565
  Gene Symbol: HNRNPH1
  Gene Name: heterogeneous nuclear ribonucleoprotein H1 (H)
  ENST ID: ENST00000630639
  CDS Start-End: 1-123
atgatgttgggcacggaaggtggagagggattcgtggtgaaggtccggggcttgccctggtcttgctcggccgatgaagtgcagaggtttttttctgcgttggtaacggaaagcgacctgtaa

SEQ ID NO: 140536 - DNA, 2223 bp, Homo sapiens
  Payload ID: 7566
  Gene Symbol: HNRNPH2
  Gene Name: heterogeneous nuclear ribonucleoprotein H2 (H')
  Uniprot ID: P55795
  ENST ID: ENST00000316594
  CDS Start-End: 79-1428
ggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaaaccatgggacacagatacgttgaagtattcaagtctaacagtgttgaaatggattgggtgttgaagcatacaggtccgaatagccctgatactgccaacgatggcttcgtccggcttagaggactcccatttggctgtagcaaggaagagattgttcagttcttttcagggttggaaattgtgccaaatgggatgacactgccagtggactttcaggggcgaagcacaggggaagcctttgtgcagtttgcttcacaggagatagctgagaaggccttaaagaaacacaaggaaagaatagggcacaggtacattgagatcttcaagagtagccgagctgaagttcgaacccactatgatccccctcgaaagctcatggctatgcagcggccaggtccctatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttataatttcttctcacctcttaatcccatgagagtacatattgaaattggacccgatggcagagttaccggtgaggcagatgttgaatttgctactcatgaagatgctgtggcagctatggcaaaagacaaagctaatatgcaacacagatatgtggagctcttcttaaattctactgcaggaacaagtgggggtgcttacgatcacagctatgtagaactttttttgaattctacagcaggggcaagtggtggcgcttatggtagccaaatgatgggagggatgggcttatccaaccagtctagttatggaggtcctgctagccagcagctgagtggtggttatggaggtggttatggtggtcagagcagtatgagtggatatgaccaagttctgcaggaaaactccagtgactatcagtcaaaccttgcttaggtagagaaggagcactaaatagctactccagatataaaagctgtacatttgtgggagttgaatagaatgggagggatgtttagtatatccagtatgattggtaaatgggaaatataattgattctgatcactcttggtcagcttctctttctttatctttctttctccttttttaagaaaacgagttaagtttaacagttttgcattacaggcttgtgattcatgcttactgtaaagtggaagttgagattattttaaaacttcaagctcagtaattttgaacactgaaacattcatctaggacataataacaaagttcagtattgaccataactgttaaaacaatttttagctttcctcaagttagttatgttgtaggagtgtacctaagcagtaagcgtatttaggttaatgcagtttcacttatgttaaatgttgctcttataccacaaatacattgaaaacttcggatgcatgttgagaaacatgcctttctgtaaaactcaaatataggagctgtgtctacgattcaaagtgaaaacatttggcatgtttgttaattctagctttttggtttaatatcctgtaaggcacgtgagtgtacactttttttttttttaaggatacgggacaattttaagatgtaataccaatactttagaagtttggtcgtgtcgtttgtatgaaaatctgaggctttggtttaaatctttccttgtattgtgatttccatttagatgtattgtactaagtgaaacttgttaaataaatcttccttttaaaaactggaaaaaa

SEQ ID NO: 140537 - DNA, 2339 bp, Homo sapiens
  Payload ID: 7567
  Gene Symbol: HNRNPH3
  Gene Name: heterogeneous nuclear ribonucleoprotein H3 (2H9)
  Uniprot ID: P31942
  ENST ID: ENST00000265866
  CDS Start-End: 166-1206
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggag

SEQ ID NO: 140538 - DNA, 1332 bp, Homo sapiens
  Payload ID: 7567
  Gene Symbol: HNRNPH3
  Gene Name: heterogeneous nuclear ribonucleoprotein H3 (2H9)
  Uniprot ID: P31942
  ENST ID: ENST00000354695
  CDS Start-End: 119-1114
ccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaac

SEQ ID NO: 140539 - DNA, 2652 bp, Homo sapiens
  Payload ID: 7568
  Gene Symbol: HNRNPK
  Gene Name: heterogeneous nuclear ribonucleoprotein K
  Uniprot ID: P61978
  ENST ID: ENST00000351839
  CDS Start-End: 108-1499
gctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaa

SEQ ID NO: 140540 - DNA, 2038 bp, Homo sapiens
  Payload ID: 7568
  Gene Symbol: HNRNPK
  Gene Name: heterogeneous nuclear ribonucleoprotein K
  Uniprot ID: P61978
  ENST ID: ENST00000360384
  CDS Start-End: 206-1597
ggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaaccta

SEQ ID NO: 140541 - DNA, 2942 bp, Homo sapiens
  Payload ID: 7568
  Gene Symbol: HNRNPK
  Gene Name: heterogeneous nuclear ribonucleoprotein K
  Uniprot ID: P61978
  ENST ID: ENST00000376263
  CDS Start-End: 225-1619
tagggcgcgacggcggggaggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgt

SEQ ID NO: 140542 - DNA, 2928 bp, Homo sapiens
  Payload ID: 7568
  Gene Symbol: HNRNPK
  Gene Name: heterogeneous nuclear ribonucleoprotein K
  Uniprot ID: P61978
  ENST ID: ENST00000376281
  CDS Start-End: 210-1604
agggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgta

SEQ ID NO: 140543 - DNA, 1283 bp, Homo sapiens
  Payload ID: 7568
  Gene Symbol: HNRNPK
  Gene Name: heterogeneous nuclear ribonucleoprotein K
  ENST ID: ENST00000457156
  CDS Start-End: 146-1283
gaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagtaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattg

SEQ ID NO: 140544 - DNA, 957 bp, Homo sapiens
  Payload ID: 7568
  Gene Symbol: HNRNPK
  Gene Name: heterogeneous nuclear ribonucleoprotein K
  ENST ID: ENST00000481820
  CDS Start-End: 1-301
gcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacaggtcagtttaagtttagctttgtgttagcttatacatactaaaacctttaaaaagcttttcttctcaattgatttttttcttttagaagccatggtgtctcaaccttttggggacctaacttctaaacattctaatagtttgccttaatttttcttctgctttcttactaaaaatgaagacattcaatactaatcttgctggaagaagccttaaccaagcaaacttctcatttctctggtgaaaactgctgccaaaaccacttgttaaaaattgtacagagcctgtagaaaatatagaagattcattggatgttggcctagttctgtgtggaagactagtgattttgttgtttttagataactaaatcgacaacaaatcacagtctgccatatggcacaggccatgcctctacaggacaaatgattggtgctgtaaaatgcagcatttcacaccttactagcattctttgtcttttctaccaaatattaacaactttcaattccgttttcttaattctgttctactaatgtccgatttactactcatcatttttcttgacacttaacattgctttaatttgtaattgctaatggtttttgaactcttctaattgtaatggacgtgtttatcattttaatttagcattgaaattgtcttgatgttgat

SEQ ID NO: 140545 - DNA, 822 bp, Homo sapiens
  Payload ID: 7568
  Gene Symbol: HNRNPK
  Gene Name: heterogeneous nuclear ribonucleoprotein K
  ENST ID: ENST00000472778
  CDS Start-End: 222-455
cgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagaccatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgag

SEQ ID NO: 140546 - DNA, 2471 bp, Homo sapiens
  Payload ID: 7569
  Gene Symbol: HNRNPL
  Gene Name: heterogeneous nuclear ribonucleoprotein L
  Uniprot ID: P14866
  ENST ID: ENST00000221419
  CDS Start-End: 368-2137
ggagaccaatgaaagtgggagggaggcggagattcttgggaggtttagagcgccgttcctatcaggtgcttttagggaggccagcagcgccagaaatccgacctatcaaattggattttattttaaggcggcggggtcgacggaaagactggcagaaagcgaccacctataaggagtgtctcagacaaacaagggcgggccctcctgcagaacggcgtgggcaatgtccaataagcgcgcaaggcgtgtggcggcctaccctccccccgcggcgggaccagtggctccccctatcgggtgggggcggcgggtgacgggcgtgtccctcccccaatgagaggcggggggaggcgggttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagca

SEQ ID NO: 140547 - DNA, 1952 bp, Homo sapiens
  Payload ID: 7569
  Gene Symbol: HNRNPL
  Gene Name: heterogeneous nuclear ribonucleoprotein L
  ENST ID: ENST00000388749
  CDS Start-End: 185-724
agtgtctgctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaagggtcgcagtgtatgtttgatgggacgccatctttcagaactgtgctaactcactgttgaagcgtccaatggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaa

SEQ ID NO: 140548 - DNA, 1918 bp, Homo sapiens
  Payload ID: 7569
  Gene Symbol: HNRNPL
  Gene Name: heterogeneous nuclear ribonucleoprotein L
  ENST ID: ENST00000601449
  CDS Start-End: 1-1591
gtgctgtactgggcgcttggtaggtggccaccctctccagggtcggggccaggacctcctgtggtgctcagaggggtcgagctgtcaggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaa

SEQ ID NO: 140549 - DNA, 593 bp, Homo sapiens
  Payload ID: 7569
  Gene Symbol: HNRNPL
  Gene Name: heterogeneous nuclear ribonucleoprotein L
  ENST ID: ENST00000601813
  CDS Start-End: 1-593
ggagaagcggcgtcggcggctggagcagaggcagcagccggacgagcagcggaggcggtcgggagcgatggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctga

SEQ ID NO: 140550 - DNA, 1633 bp, Homo sapiens
  Payload ID: 7569
  Gene Symbol: HNRNPL
  Gene Name: heterogeneous nuclear ribonucleoprotein L
  Uniprot ID: P14866
  ENST ID: ENST00000600873
  CDS Start-End: 176-1546
tcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagat

SEQ ID NO: 140551 - DNA, 659 bp, Homo sapiens
  Payload ID: 7569
  Gene Symbol: HNRNPL
  Gene Name: heterogeneous nuclear ribonucleoprotein L
  ENST ID: ENST00000600233
  CDS Start-End: 1-659
tggctccatgcgcaggcgcagtgttcccgcccggcctcgtgggcggttaggggagcgcctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaacccca

SEQ ID NO: 140552 - DNA, 659 bp, Homo sapiens; identical to SEQ ID NO: 140551
  Payload ID: 7569
  Gene Symbol: HNRNPL
  Gene Name: Heterogeneous nuclear ribonucleoprotein L
  ENST ID: ENST00000634376
  CDS Start-End: 1-659

SEQ ID NO: 140553 - DNA, 2471 bp, Homo sapiens; identical to SEQ ID NO: 140546
  Payload ID: 7569
  Gene Symbol: HNRNPL
  Gene Name: Heterogeneous nuclear ribonucleoprotein L
  ENST ID: ENST00000634753
  CDS Start-End: 368-2137

SEQ ID NO: 140554 - DNA, 1633 bp, Homo sapiens; identical to SEQ ID NO: 140550
  Payload ID: 7569
  Gene Symbol: HNRNPL
  Gene Name: Heterogeneous nuclear ribonucleoprotein L
  ENST ID: ENST00000634237
  CDS Start-End: 176-1546

SEQ ID NO: 140555 - DNA, 593 bp, Homo sapiens; identical to SEQ ID NO: 140549
  Payload ID: 7569
  Gene Symbol: HNRNPL
  Gene Name: Heterogeneous nuclear ribonucleoprotein L
  ENST ID: ENST00000635025
  CDS Start-End: 1-593

SEQ ID NO: 140556 - DNA, 1918 bp, Homo sapiens; identical to SEQ ID NO: 140548
  Payload ID: 7569
  Gene Symbol: HNRNPL
  Gene Name: Heterogeneous nuclear ribonucleoprotein L
  ENST ID: ENST00000634312
  CDS Start-End: 1-1591

SEQ ID NO: 140557 - DNA, 1952 bp, Homo sapiens; identical to SEQ ID NO: 140547
  Payload ID: 7569
  Gene Symbol: HNRNPL
  Gene Name: Heterogeneous nuclear ribonucleoprotein L
  ENST ID: ENST00000634983
  CDS Start-End: 185-724

SEQ ID NO: 140558 - DNA, 2190 bp, Homo sapiens
  Payload ID: 7570
  Gene Symbol: HNRNPLL
  Gene Name: heterogeneous nuclear ribonucleoprotein L-like
  ENST ID: ENST00000272249
  CDS Start-End: 1-653
gtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggttgttgttggcttatgctgaaacttcttgaaagaagcccactttgaaaatgtgttgctgttgaagctaatagtatgattcagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatga

SEQ ID NO: 140559 - DNA, 2779 bp, Homo sapiens
  Payload ID: 7570
  Gene Symbol: HNRNPLL
  Gene Name: heterogeneous nuclear ribonucleoprotein L-like
  ENST ID: ENST00000358367
  CDS Start-End: 170-1783
ggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgcttatgtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactg

SEQ ID NO: 140560 - DNA, 2523 bp, Homo sapiens
  Payload ID: 7570
  Gene Symbol: HNRNPLL
  Gene Name: heterogeneous nuclear ribonucleoprotein L-like
  ENST ID: ENST00000378915
  CDS Start-End: 1-1527
atgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactg

SEQ ID NO: 140561 - DNA, 1908 bp, Homo sapiens
  Payload ID: 7570
  Gene Symbol: HNRNPLL
  Gene Name: heterogeneous nuclear ribonucleoprotein L-like
  Uniprot ID: Q8WVV9
  ENST ID: ENST00000409328
  CDS Start-End: 232-1758
ggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgatcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaa

SEQ ID NO: 140562 - DNA, 1687 bp, Homo sapiens
  Payload ID: 7570
  Gene Symbol: HNRNPLL
  Gene Name: heterogeneous nuclear ribonucleoprotein L-like
  Uniprot ID: Q8WVV9
  ENST ID: ENST00000410076
  CDS Start-End: 63-890
catccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggtaggtattttatacattttagaatgtacttgatctgctgacaaatttttatatgcagttagattcttttttcctgagatgagctagttaattcaaatgaaaaccttgttgatgaatgcttttgttgcaaaaggccatgtaatgctggaaaataaccttgaacattagtgccccctactggtatgtactgagctatttatatttagttcaacaaggagcccacacattcaggcacgcccgcagttcaaggacttgcatttctccaagcagctctctctctttggaggagaggaaactgattcagaatattccttacaaactgcaaacttgcacactgcttctctatggaaaggactttcccccaagctggacgaggcattaagaaggatagaggactccagcaggctgactctacacttcatcatgcacaacatcggcatcagcaaaaagccctctgaaaaactcagactcgcaattcaccttgactgcatactgcatgcaccatcaccccaagtttttaaaggaggacacttaacagtacttcagaattgcatgggatgaacaccatgatagactgtgcccatttatacaagttgtatgtatatattggtctgatttcccttaaggtttcagttgtagaatttaagactttccactaacggaaactagacttcatctgcaatgttgtaaatcttaatgcccattactgtgactgtgtgcagcttagattcaaattgttaattggcaaataaccaggaccagtttattaacaggtcttgggaattgataatgctcaaccaatccacacagatagaaaaataaaaggattagaaaggtg

SEQ ID NO: 140563 - DNA, 3980 bp, Homo sapiens
  Payload ID: 7570
  Gene Symbol: HNRNPLL
  Gene Name: heterogeneous nuclear ribonucleoprotein L-like
  Uniprot ID: Q8WVV9
  ENST ID: ENST00000409636
  CDS Start-End: 163-1776
atcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagtggaccagcatttagccctctaaagataaagaaaaaattaaatttaatctagaagtattttagacccttatcacagaacccagtaagttatgccaagggtaactgtgtgaactgtgttcgatactgggctatgtatgtttcttattcattgccaatttaatacctaagtttatctaactttacaataaagctttttttcccctataaatacttttctacctcttttgaaaaattgaaataccttaattttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactga

SEQ ID NO: 140564 - DNA, 4173 bp, Homo sapiens
  Payload ID: 7570
  Gene Symbol: HNRNPLL
  Gene Name: heterogeneous nuclear ribonucleoprotein L-like
  Uniprot ID: Q8WVV9
  ENST ID: ENST00000449105
  CDS Start-End: 341-1969
ggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagtggaccagcatttagccctctaaagataaagaaaaaattaaatttaatctagaagtattttagacccttatcacagaacccagtaagttatgccaagggtaactgtgtgaactgtgttcgatactgggctatgtatgtttcttattcattgccaatttaatacctaagtttatctaactttacaataaagctttttttcccctataaatacttttctacctcttttgaaaaattgaaataccttaattttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactga

SEQ ID NO: 140565 - DNA, 570 bp, Homo sapiens
  Payload ID: 7570
  Gene Symbol: HNRNPLL
  Gene Name: heterogeneous nuclear ribonucleoprotein L-like
  ENST ID: ENST00000425682
  CDS Start-End: 124-570
actgtcttgtgcttcttcgttcacatgtttggtaattcattgtaaccgaaaagggttttgcacaacttcagtggtccttcagcccagagaagaaatacctttgtggtcagactgttaaagtaaatgcaggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggtt

SEQ ID NO: 140566 - DNA, 512 bp, Homo sapiens
  Payload ID: 7570
  Gene Symbol: HNRNPLL
  Gene Name: heterogeneous nuclear ribonucleoprotein L-like
  ENST ID: ENST00000441689
  CDS Start-End: 1-400
tgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgagtaagtaaaatgctttatttgtgttgtaattatgtagtggcagttaccatcacagaaacattcatggtaatataaaaataacacttaataggcttcttaaaaaatacagataaatacaaa

SEQ ID NO: 140567 - DNA, 3035 bp, Homo sapiens
  Payload ID: 7570
  Gene Symbol: HNRNPLL
  Gene Name: heterogeneous nuclear ribonucleoprotein L-like
  ENST ID: ENST00000608859
  CDS Start-End: 411-2039
ggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgcttatgtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactg

SEQ ID NO: 140568 - DNA, 2494 bp, Homo sapiens
  Payload ID: 7571
  Gene Symbol: HNRNPM
  Gene Name: heterogeneous nuclear ribonucleoprotein M
  Uniprot ID: P52272
  ENST ID: ENST00000325495
  CDS Start-End: 42-2234
gtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 140569 - DNA, 2568 bp, Homo sapiens
  Payload ID: 7571
  Gene Symbol: HNRNPM
  Gene Name: heterogeneous nuclear ribonucleoprotein M
  Uniprot ID: P52272
  ENST ID: ENST00000348943
  CDS Start-End: 233-2308
cgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaa

SEQ ID NO: 140570 - DNA, 409 bp, Homo sapiens
  Payload ID: 7571
  Gene Symbol: HNRNPM
  Gene Name: heterogeneous nuclear ribonucleoprotein M
  ENST ID: ENST00000598999
  CDS Start-End: 1-350
agcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggtaagtgttgggaacggctttgtaggtgcttccctcgtgcttgttggtgacgcagccgagtcagcagcaaaacctccctcccagccccctccgtcggctcaggacccat

SEQ ID NO: 140571 - DNA, 298 bp, Homo sapiens
  Payload ID: 7571
  Gene Symbol: HNRNPM
  Gene Name: heterogeneous nuclear ribonucleoprotein M
  ENST ID: ENST00000598367
  CDS Start-End: 1-298
ggatgtgctgttgttgaattcaagatggaagagagcatgaaaaaagctgcggaacgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatg

SEQ ID NO: 140572 - DNA, 664 bp, Homo sapiens
  Payload ID: 7571
  Gene Symbol: HNRNPM
  Gene Name: heterogeneous nuclear ribonucleoprotein M
  ENST ID: ENST00000596984
  CDS Start-End: 7-664
gagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagggattgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaaga

SEQ ID NO: 140573 - DNA, 1147 bp, Homo sapiens
  Payload ID: 7571
  Gene Symbol: HNRNPM
  Gene Name: heterogeneous nuclear ribonucleoprotein M
  ENST ID: ENST00000597270
  CDS Start-End: 1-1147
tggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggc

SEQ ID NO: 140574 - DNA, 1086 bp, Homo sapiens
  Payload ID: 7571
  Gene Symbol: HNRNPM
  Gene Name: heterogeneous nuclear ribonucleoprotein M
  ENST ID: ENST00000600092
  CDS Start-End: 29-1086
gctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctgg

SEQ ID NO: 140575 - DNA, 832 bp, Homo sapiens
  Payload ID: 7571
  Gene Symbol: HNRNPM
  Gene Name: heterogeneous nuclear ribonucleoprotein M
  ENST ID: ENST00000601645
  CDS Start-End: 6-832
agaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatggg

SEQ ID NO: 140576 - DNA, 2373 bp, Homo sapiens
  Payload ID: 7571
  Gene Symbol: HNRNPM
  Gene Name: heterogeneous nuclear ribonucleoprotein M
  ENST ID: ENST00000600806
  CDS Start-End: 23-322
acaaagcccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctg

SEQ ID NO: 140577 - DNA, 910 bp, Homo sapiens
  Payload ID: 7571
  Gene Symbol: HNRNPM
  Gene Name: heterogeneous nuclear ribonucleoprotein M
  ENST ID: ENST00000596295
  CDS Start-End: 1-643
cattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcgaacctgagcggcaagtgctgcacgtgtcccgcaatgctctcgtgtgagccaattactggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagat

SEQ ID NO: 140578 - DNA, 1078 bp, Homo sapiens
  Payload ID: 7571
  Gene Symbol: HNRNPM
  Gene Name: heterogeneous nuclear ribonucleoprotein M
  ENST ID: ENST00000594907
  CDS Start-End: 8-1078
ggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaaggggatgtgctgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctcc

SEQ ID NO: 140579 - DNA, 2458 bp, Homo sapiens
  Payload ID: 7571
  Gene Symbol: HNRNPM
  Gene Name: heterogeneous nuclear ribonucleoprotein M
  ENST ID: ENST00000620401
  CDS Start-End: 10-2202
gcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatacgtggagctcttaatggacgctgaaggaaagtcaagggtaagtgttgttgttgaattcaagatggaagagagcatgaaaaaagctgcggaagtcctaaacaagcatagtctgagcggaagaccactgaaagtcaaagaagatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatctatgttcaatggccagctgctatttgatagaccaatgcacgtcaagatggatgagagggccttaccaaaaggagatttcttccctcctgagcgtccacaacaacttccccatggccttggtggtattggcatggggttaggaccaggagggcaacccattgatgccaatcacctgaataaaggcatcggaatgggaaacataggtcccgcaggaatgggaatggaaggcataggatttggaataaataaaatgggaggaatggaggggccctttggtggtggtatggaaaacatgggtcgatttggatctgggatgaacatgggcaggataaatgaaatcctaagtaatgcactgaagagaggagagatcattgcaaagcagggaggaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctg

SEQ ID NO: 140580 - DNA, 2629 bp, Homo sapiens
  Payload ID: 7572
  Gene Symbol: HNRNPR
  Gene Name: heterogeneous nuclear ribonucleoprotein R
  Uniprot ID: O43390
  ENST ID: ENST00000302271
  CDS Start-End: 62-1963
gcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 140581 - DNA, 2694 bp, Homo sapiens
  Payload ID: 7572
  Gene Symbol: HNRNPR
  Gene Name: heterogeneous nuclear ribonucleoprotein R
  Uniprot ID: O43390
  ENST ID: ENST00000374612
  CDS Start-End: 125-2026
gtctcagtccatcaggggggggagggggtggcgcgcgcgccatttctagtcgttttcaaagcgcctcgcgctgattctcacgggcccggctgccggcccccgctctgccctgcagcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaaca

SEQ ID NO: 140582 - DNA, 2691 bp, Homo sapiens
  Payload ID: 7572
  Gene Symbol: HNRNPR
  Gene Name: heterogeneous nuclear ribonucleoprotein R
  Uniprot ID: O43390
  ENST ID: ENST00000374616
  CDS Start-End: 110-2020
caggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacaggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacatta

SEQ ID NO: 140583 - DNA, 1788 bp, Homo sapiens
  Payload ID: 7572
  Gene Symbol: HNRNPR
  Gene Name: heterogeneous nuclear ribonucleoprotein R
  Uniprot ID: O43390
  ENST ID: ENST00000427764
  CDS Start-End: 1-1788
atggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtag

SEQ ID NO: 140584 - DNA, 7646 bp, Homo sapiens
  Payload ID: 7572
  Gene Symbol: HNRNPR
  Gene Name: heterogeneous nuclear ribonucleoprotein R
  Uniprot ID: O43390
  ENST ID: ENST00000478691
  CDS Start-End: 273-1880
gctgccgggatcgcgtctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacaggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaacaggttcatagacttttgagcattcttgcaggcattggataatttgcattaaaacaaataaaatgtggctgggaaagcagactgcaatttattttgacccacattctttataagggataatttgtgactgaagaccttatttgctggataagtgaatgtacatacagggaaaattgttagtactgtggcgtcaattgcactgcggactttagttttagtgaaaatgatcgtgactaccatttcagttactggtttaggaatataatttcctattactatgtaaatttgctttgagaaacattcatgccttgtaagagaggcttaaaaatatccagtagtaatacctttgactttctgttaacacttcgtttatttttatttatctgctatccctgatgcccaaattttttgttggccaagacataacatctatttccctatttcctttagaaattctgatttattctaatgacttttttgcttgagaatgagaggaacaaaagaatctaagctttacggtacagaaaagtgaatcactttcaaattactattaagttttcccctccatcttattcttacgtggttctcaaatgtttttataatgataaaaatatcagaagccattggggaataattaaaatggatacaccattattctgtgttttgttcctgtttggtgtctttgtgataggaatattagatttcaaaatcataagccacttaattccgtgtaatcttggctagatcatattgggtttcatggcttcttttcatttcaatttaagattactatttactgatgaaagtcaatatatttcatttctttttcaaagtacactcattacacagtatagtcatttaacagaccttattgatattttagttttttggaaactgataaaggaattatggtctgttgtatgatagttttgagttaacatgggtatttctttggtaagacagatccagttgtttttcttatgcccatgtatgcaagtaaagacaccaaacattctttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttataggttttgtggctattttaaattgtaaagcataatcctataaacattaaaactcaagagcttttcttctttcatgtcttgtaaattaacactgtagcagcattcagagaaaatagattcagagctcaacttttcacataaataaatctaacagtgtaatatataaacctgaaaaatgtcagttgagggaggtctttattctagattggcatttttttttttttaaattaggtacaaattatgagtgtaaggaatttggtttcctgctctcctgtctttccatcttttttgttccccaagctaattgatttggctttatttatgagcctgttacagtaaagtgtgtgttgggaaatatattgaggtatagagctattctttgtaggtaccctggtgagaccgatacaaatatgcccctccccataatggaatactaatttttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaacgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttttatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctcttggagagacaataaatttgctttaactgtcatttcagtctagtattatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagagtcaatatttaaattattgctaaagattaaaatccctcatcttatagtttgtaggggattccatgatggtaaggtatagattgaaattaaatttagtaactaggcatttctgaccataccatataaaaaataattgtaatatggtataaacactgattaaaagtaattatggattttcatgcctgaagaaccttctcagtattcttacagcactgtatcttctttattggttgagaatatcagtctagaaagactttcctagatgttaaatgtgctagtcagtgtcatgaatataaacccttacttgtaagtttgctatagactagttgtacaacactagaatgaaattatgtaatacttttaagaattgtagtgattgcagggttgtgttaaggtaacattttatgcatgtgtcagtgacagaaaggatcagggtataaaacttagcactaaatagcatgctccttaggaagttttaaggtaagcagtaggaatattcatgtaattctgatgagtttatgtaagttaaggaaaatgcaatgccagtttgttgactttaaacactaaaaacaaaatacattttgtggaaccaacaaaggagacattctggggaaaaacttaaattgctcaaatttaaataagggctctcactttatatagtagatttgtcaggatcccatgaacattgcttttcttgatttctcacatatgagggttgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttcaaaa

SEQ ID NO: 140585 - DNA, 1837 bp, Homo sapiens
  Payload ID: 7572
  Gene Symbol: HNRNPR
  Gene Name: heterogeneous nuclear ribonucleoprotein R
  ENST ID: ENST00000606561
  CDS Start-End: 232-1716
gtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtatt

SEQ ID NO: 140586 - DNA, 1788 bp, Homo sapiens; identical to SEQ ID NO: 140583
  Payload ID: 7572
  Gene Symbol: HNRNPR
  Gene Name: Heterogeneous nuclear ribonucleoprotein R
  ENST ID: ENST00000634634
  CDS Start-End: 1-1788

SEQ ID NO: 140587 - DNA, 2691 bp, Homo sapiens; identical to SEQ ID NO: 140582
  Payload ID: 7572
  Gene Symbol: HNRNPR
  Gene Name: Heterogeneous nuclear ribonucleoprotein R
  ENST ID: ENST00000634713
  CDS Start-End: 110-2020

SEQ ID NO: 140588 - DNA, 2629 bp, Homo sapiens; identical to SEQ ID NO: 140580
  Payload ID: 7572
  Gene Symbol: HNRNPR
  Gene Name: Heterogeneous nuclear ribonucleoprotein R
  ENST ID: ENST00000634766
  CDS Start-End: 62-1963

SEQ ID NO: 140589 - DNA, 7646 bp, Homo sapiens; identical to SEQ ID NO: 140584
  Payload ID: 7572
  Gene Symbol: HNRNPR
  Gene Name: Heterogeneous nuclear ribonucleoprotein R
  ENST ID: ENST00000635150
  CDS Start-End: 273-1880

SEQ ID NO: 140590 - DNA, 2694 bp, Homo sapiens; identical to SEQ ID NO: 140581
  Payload ID: 7572
  Gene Symbol: HNRNPR
  Gene Name: Heterogeneous nuclear ribonucleoprotein R
  ENST ID: ENST00000634263
  CDS Start-End: 125-2026

SEQ ID NO: 140591 - DNA, 1837 bp, Homo sapiens; identical to SEQ ID NO: 140585
  Payload ID: 7572
  Gene Symbol: HNRNPR
  Gene Name: Heterogeneous nuclear ribonucleoprotein R
  ENST ID: ENST00000635199
  CDS Start-End: 232-1716

SEQ ID NO: 140592 - DNA, 3704 bp, Homo sapiens
  Payload ID: 7573
  Gene Symbol: HNRNPU
  Gene Name: heterogeneous nuclear ribonucleoprotein U (scaffold attachment factor A)
  Uniprot ID: Q00839
  ENST ID: ENST00000283179
  CDS Start-End: 165-2642
cgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcatttta

SEQ ID NO: 140593 - DNA, 5940 bp, Homo sapiens
  Payload ID: 7573
  Gene Symbol: HNRNPU
  Gene Name: heterogeneous nuclear ribonucleoprotein U (scaffold attachment factor A)
  Uniprot ID: Q00839
  ENST ID: ENST00000444376
  CDS Start-End: 236-2656
aggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagaataaacagagaggcataaacatatcttagagtccaagtggtagtgtttagcattggatataataaatggatgttttacaaagtg

SEQ ID NO: 140594 - DNA, 1067 bp, Homo sapiens
  Payload ID: 7573
  Gene Symbol: HNRNPU
  Gene Name: heterogeneous nuclear ribonucleoprotein U (scaffold attachment factor A)
  ENST ID: ENST00000440865
  CDS Start-End: 343-1067
agtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagcc

SEQ ID NO: 140595 - DNA, 2952 bp, Homo sapiens
  Payload ID: 7574
  Gene Symbol: HNRNPUL1
  Gene Name: heterogeneous nuclear ribonucleoprotein U-like 1
  ENST ID: ENST00000263367
  CDS Start-End: 195-2498
gttttccgtttgggttggggagggtctcgaaaatggggatcctagggtacggagctccgtgggcttggcggtcgtgctagcccagcgtgtgggctggggggtggggagccgtgtttccagggtggggaaggaatgtccaggtgtgcggggctgcgagagttctgaggaaggaggatcctggaatatgccgctggatgcgatcctgggcgttctcctatttggatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggatt

SEQ ID NO: 140596 - DNA, 3426 bp, Homo sapiens
  Payload ID: 7574
  Gene Symbol: HNRNPUL1
  Gene Name: heterogeneous nuclear ribonucleoprotein U-like 1
  ENST ID: ENST00000352456
  CDS Start-End: 93-2393
attgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttat

SEQ ID NO: 140597 - DNA, 2864 bp, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENST ID: ENST00000378215
  CDS Start-End: 133-2391
attttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaaggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaactt

SEQ ID NO: 140598 - DNA, 3555 bp, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENST ID: ENST00000392006
  CDS Start-End: 174-2744
cggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaacctttt

SEQ ID NO: 140599 - DNA, 644 bp, Homo sapiens
  Payload ID: 7574
  Gene Symbol: HNRNPUL1
  Gene Name: heterogeneous nuclear ribonucleoprotein U-like 1
  ENST ID: ENST00000600332
  CDS Start-End: 1-80
gaaggggccgtgtatgcttcgagatgaaggtgagtaggagcaagagaaggggaagggacagagaagtccatccattgtaatatcctgataccagccaccttggtcagagctgcaactgcaaaagagattggattgtgcaataccatgtccaagcagacaaaactgtgatgaactcaagacaactacatcattgctaaatatcatatcagaaaagcaggccaaccatgcattgcttcatcaagcagatatttccttggtgagatttgacccaggtattatgtagtcaaccagtgtagtgatgacatgtttgtagaactgagaaaagaagttgtttggaagaaaagtgatctagaaagaatagactcagatgtcacttattaaagggaggccagagggagaacagggcaaagaactgccagcttaggccagcctctgctgtcatctctccacagttccatgtcaagttatgtttatgaaaataatagatgctcatgtttaacaaaagttcagacagcacagaaaagtacaggataaaacaggcttgagccaccgtgcccggcctactttgctctttttaactgttgcatcatattttgtggcatggatataccataatcagtgctttattgatattttttctgatg

SEQ ID NO: 140600 - DNA, 573 bp, Homo sapiens
  Payload ID: 7574
  Gene Symbol: HNRNPUL1
  Gene Name: heterogeneous nuclear ribonucleoprotein U-like 1
  ENST ID: ENST00000597725
  CDS Start-End: 56-573
aagtcggacgtgggcgaggggcggggtgtctggactggaacctctgggcccacaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaa

SEQ ID NO: 140601 - DNA, 581 bp, Homo sapiens
  Payload ID: 7574
  Gene Symbol: HNRNPUL1
  Gene Name: heterogeneous nuclear ribonucleoprotein U-like 1
  ENST ID: ENST00000600596
  CDS Start-End: 1-271
tacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatc

SEQ ID NO: 140602 - DNA, 1473 bp, Homo sapiens
  Payload ID: 7574
  Gene Symbol: HNRNPUL1
  Gene Name: heterogeneous nuclear ribonucleoprotein U-like 1
  ENST ID: ENST00000599719
  CDS Start-End: 361-1473
gttatctttattattcgatgccgcctgcctctgcggaccgtagtgggcacatctacactgcagcggggtgccttacccaaagcagatcggaattggggccgggcgcggtggctcacgcctgtaatcccagcactttgggaggccgaggcgggcggatcacttgaggtcaggagttcgagaccagcctggccaacatggtgaaaccccgtctctactaaaaatacaaaaattagtcgggcatggtggcggggacctgtaatcccagctactcggaaggctgaggcaggagaatcgcttgaacacgggaggcggaggttgcggtgagctgagatagaggccctgcactccagccaggatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcgg

SEQ ID NO: 140603 - DNA, 2932 bp, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENST ID: ENST00000602130
  CDS Start-End: 54-2468
cagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaa

SEQ ID NO: 140604 - DNA, 672 bp, Homo sapiens
  Payload ID: 7574
  Gene Symbol: HNRNPUL1
  Gene Name: heterogeneous nuclear ribonucleoprotein U-like 1
  ENST ID: ENST00000601309
  CDS Start-End: 317-672
attattcgatgccgcctgcctctgcggaccgtagtgggcacatctacactgcagcggggtgccttacccaaagcagatcggaattggggccgggcgcggtggctcacgcctgtaatcccagcactttgggaggccgaggcgggcggatcacttgaggtcaggagttcgagaccagcctggccaacatggtgaaaccccgtctctactaaaaatacaaaaattagtcgggcatggtggcggggacctgtaatcccagctactcggaaggctgaggcaggagaatcgcttgaacacgggaggcggaggttgcgatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcga

SEQ ID NO: 140605 - DNA, 754 bp, Homo sapiens
  Payload ID: 7574
  Gene Symbol: HNRNPUL1
  Gene Name: heterogeneous nuclear ribonucleoprotein U-like 1
  ENST ID: ENST00000601336
  CDS Start-End: 281-754
gaaagggctgtgggacgcgggagtccagcgcctgaggtcggggagacgacctgaggatcgggggatcccgctacccgccgccgaaaaggatctggggaccagggccccagcacgaccggagggtggatcctgacactcagtgcaggggggacactgggggaggggcctctgggtttcggaggtgagggacgggggtggcggggaggattccgtaccgtagggatcggagaccggaaactgctttctggagccgaagagagtcggaagaacaagagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgc

SEQ ID NO: 140606 - DNA, 393 bp, Homo sapiens
  Payload ID: 7574
  Gene Symbol: HNRNPUL1
  Gene Name: heterogeneous nuclear ribonucleoprotein U-like 1
  ENST ID: ENST00000595336
  CDS Start-End: 151-393
tagtatgcatgccatgaatagttaatattattattcttaccactcttagttgagctcctggacctgcagatgccttctggatgctttggtccagggttcttcatgaaccgcccctctaattggccatttttaattttgttttaagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgg

SEQ ID NO: 140607 - DNA, 3043 bp, Homo sapiens
  Payload ID: 7574
  Gene Symbol: HNRNPUL1
  Gene Name: heterogeneous nuclear ribonucleoprotein U-like 1
  ENST ID: ENST00000595196
  CDS Start-End: 94-411
tttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaa

SEQ ID NO: 140608 - DNA, 2725 bp, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENST ID: ENST00000593587
  CDS Start-End: 95-2365
ggaaactgctttctggagccgaagagagtcggaagaacaagaggttttccgtttgggttggggagggtctcgaaaatggggatcctaggatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactct

SEQ ID NO: 140609 - DNA, 2794 bp, Homo sapiens
  Payload ID: 7574
  Gene Symbol: HNRNPUL1
  Gene Name: heterogeneous nuclear ribonucleoprotein U-like 1
  Uniprot ID: Q9BUJ2
  ENST ID: ENST00000595018
  CDS Start-End: 70-2340
agagagagaggaagtcggacgtgggcgaggggcggggtgtctggactggaacctctgggcccacatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggatt

SEQ ID NO: 140610 - DNA, 2447 bp, Homo sapiens
  Payload ID: 7574
  Gene Symbol: HNRNPUL1
  Gene Name: heterogeneous nuclear ribonucleoprotein U-like 1
  ENST ID: ENST00000599614
  CDS Start-End: 1-1925
gcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtg

SEQ ID NO: 140611 - DNA, 451 bp, Homo sapiens
  Payload ID: 7574
  Gene Symbol: HNRNPUL1
  Gene Name: heterogeneous nuclear ribonucleoprotein U-like 1
  ENST ID: ENST00000617774
  CDS Start-End: 83-451
gcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggctgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataa

SEQ ID NO: 140612 - DNA, 1018 bp, Homo sapiens
  Payload ID: 7574
  Gene Symbol: HNRNPUL1
  Gene Name: heterogeneous nuclear ribonucleoprotein U-like 1
  ENST ID: ENST00000617305
  CDS Start-End: 47-415
ctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaactt

SEQ ID NO: 140613 - DNA, 5106 bp, Homo sapiens
  Payload ID: 7575
  Gene Symbol: HNRNPUL2
  Gene Name: heterogeneous nuclear ribonucleoprotein U-like 2
  Uniprot ID: Q1KMD3
  ENST ID: ENST00000301785
  CDS Start-End: 194-2437
acgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattca

SEQ ID NO: 140614 - DNA, 3600 bp, Homo sapiens
  Payload ID: 7576
  Gene Symbol: HEXIM1
  Gene Name: hexamethylene bis-acetamide inducible 1
  Uniprot ID: O94992
  ENST ID: ENST00000332499
  CDS Start-End: 690-1769
gcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttgaaata

SEQ ID NO: 140615 - DNA, 1528 bp, Homo sapiens
  Payload ID: 7577
  Gene Symbol: HEXIM2
  Gene Name: hexamethylene bis-acetamide inducible 2
  Uniprot ID: Q96MH2
  ENST ID: ENST00000307275
  CDS Start-End: 437-1297
acactttaggcgtttcaccaagaggctggcgacatgctaggtcaggttgtccggagaatcggggctgaatgggagagatcttgagggcaagagcctcagagaccttcaggcaccgagctcgtgaaggtttccaagtgcccctctctagctgctcccagggggaattagtggttgctacagtagtttaagagggtcgtggtttttcgcaacccgggcggcgagatggcgctttggtgtaagcgaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaatggga

SEQ ID NO: 140616 - DNA, 473 bp, Homo sapiens
  Payload ID: 7577
  Gene Symbol: HEXIM2
  Gene Name: hexamethylene bis-acetamide inducible 2
  ENST ID: ENST00000591070
  CDS Start-End: 237-473
tggcctgagcggcttgaccagagctgctgcaactgcagcaagaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggc

SEQ ID NO: 140617 - DNA, 783 bp, Homo sapiens
  Payload ID: 7577
  Gene Symbol: HEXIM2
  Gene Name: hexamethylene bis-acetamide inducible 2
  ENST ID: ENST00000586681
  CDS Start-End: 352-783
cctctgtgcggggcctcgccgccatacccaggccgaatgggggtggggagggaagctggcagagctcggcctcaggatccgcgcccctgtggaaagaccgcagagggaagccgtttcaccagcctctccccttctggggtctcgggaaacacgcggtaattaccgaagaaccccgcactctgtgagaggcgaggctgcggggctgccgggacggtttgaggaccgggctcggccgaggagactccaaccttcaccctccctggcccccggtcccacttcccgccgtctcccggcgccgccacttcaggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacc

SEQ ID NO: 140618 - DNA, 1176 bp, Homo sapiens
  Payload ID: 7577
  Gene Symbol: HEXIM2
  Gene Name: hexamethylene bis-acetamide inducible 2
  Uniprot ID: Q96MH2
  ENST ID: ENST00000591576
  CDS Start-End: 90-950
gtggcctgagcggcttgaccagagctgctgcaactgcagcaagaggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaa

SEQ ID NO: 140619 - DNA, 796 bp, Homo sapiens
  Payload ID: 7577
  Gene Symbol: HEXIM2
  Gene Name: hexamethylene bis-acetamide inducible 2
  ENST ID: ENST00000589230
  CDS Start-End: 380-796
aatccccagcaggcaccgcgcgtccaggctctctcttcccccccatcttagtggcctgagcggcttgaccagagctgctgcaactgcagcaagaggtagggctcaggcgttgggaattgcaccgacaggcagtcgcacagaaaggcacacagatgtagtggtgtgcatagcccttgacagcgaataggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggcc

SEQ ID NO: 140620 - DNA, 1246 bp, Homo sapiens
  Payload ID: 7577
  Gene Symbol: HEXIM2
  Gene Name: hexamethylene bis-acetamide inducible 2
  Uniprot ID: Q96MH2
  ENST ID: ENST00000592695
  CDS Start-End: 160-1020
agctgctgcaactgcagcaagaggtagggctcaggcgttgggaattgcaccgacaggcagtcgcacagaaaggcacacagatgtagtggtgtgcatagcccttgacagcgaataggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaa

SEQ ID NO: 140621 - DNA, 803 bp, Homo sapiens
  Payload ID: 7577
  Gene Symbol: HEXIM2
  Gene Name: hexamethylene bis-acetamide inducible 2
  ENST ID: ENST00000585340
  CDS Start-End: 193-803
gacatgctaggtcaggttgtccggagaatcggggctgaatgggagagatcttgagggcaagagcctcagagaccttcaggcaccgagctcgtgaaggtttccaagtgcccctctctagctgctcccagggggaattagtggttgctacagtagtttaagagggtcgtggtttttcgcaacccgggcggcgagatggcgctttggtgtaagcgaggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcgggg

SEQ ID NO: 140622 - DNA, 581 bp, Homo sapiens
  Payload ID: 7577
  Gene Symbol: HEXIM2
  Gene Name: hexamethylene bis-acetamide inducible 2
  ENST ID: ENST00000593138
  CDS Start-End: 216-581
agtcgaagtgggagtccctctgtgcggggcctcgccgccatacccaggccgaatgggggtggggagggaagctggcagagctcggcctcaggatccgcgcccctgtggaaagaccgcagagggaagccgtttcaccagcctctccccttctggggtctcgggaaacacgcggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccag

SEQ ID NO: 140623 - DNA, 3596 bp, Homo sapiens
  Payload ID: 7578
  Gene Symbol: HK1
  Gene Name: hexokinase 1
  Uniprot ID: P19367
  ENST ID: ENST00000298649
  CDS Start-End: 102-2852
cctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 140624 - DNA, 3605 bp, Homo sapiens
  Payload ID: 7578
  Gene Symbol: HK1
  Gene Name: hexokinase 1
  Uniprot ID: P19367
  ENST ID: ENST00000359426
  CDS Start-End: 105-2858
gaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 140625 - DNA, 3961 bp, Homo sapiens
  Payload ID: 7578
  Gene Symbol: HK1
  Gene Name: hexokinase 1
  Uniprot ID: P19367
  ENST ID: ENST00000360289
  CDS Start-End: 500-3217
aaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 140626 - DNA, 707 bp, Homo sapiens
  Payload ID: 7578
  Gene Symbol: HK1
  Gene Name: hexokinase 1
  ENST ID: ENST00000421088
  CDS Start-End: 365-707
gttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagcttt

SEQ ID NO: 140627 - DNA, 3868 bp, Homo sapiens
  Payload ID: 7578
  Gene Symbol: HK1
  Gene Name: hexokinase 1
  Uniprot ID: P19367
  ENST ID: ENST00000448642
  CDS Start-End: 359-3124
aaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 140628 - DNA, 739 bp, Homo sapiens
  Payload ID: 7578
  Gene Symbol: HK1
  Gene Name: hexokinase 1
  ENST ID: ENST00000450646
  CDS Start-End: 321-739
agaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggaga

SEQ ID NO: 140629 - DNA, 1042 bp, Homo sapiens
  Payload ID: 7578
  Gene Symbol: HK1
  Gene Name: hexokinase 1
  ENST ID: ENST00000436817
  CDS Start-End: 171-1042
ccaggttgcatgaggggttgggggtgggatggacagagcactggctgggcatcaggactaggctggagtcctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagct

SEQ ID NO: 140630 - DNA, 5772 bp, Homo sapiens
  Payload ID: 7579
  Gene Symbol: HK2
  Gene Name: hexokinase 2
  Uniprot ID: P52789
  ENST ID: ENST00000290573
  CDS Start-End: 601-3354
cggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 140631 - DNA, 5278 bp, Homo sapiens
  Payload ID: 7579
  Gene Symbol: HK2
  Gene Name: hexokinase 2
  ENST ID: ENST00000409174
  CDS Start-End: 191-2860
acccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 140632 - DNA, 3066 bp, Homo sapiens
  Payload ID: 7580
  Gene Symbol: HK3
  Gene Name: hexokinase 3 (white cell)
  Uniprot ID: P52790
  ENST ID: ENST00000292432
  CDS Start-End: 93-2864
gggtgcctcatattgccagacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttattta

SEQ ID NO: 140633 - DNA, 450 bp, Homo sapiens
  Payload ID: 7580
  Gene Symbol: HK3
  Gene Name: hexokinase 3 (white cell)
  ENST ID: ENST00000509717
  CDS Start-End: 1-321
ctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgactttgcaggccttaggaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgaccacatcgtggactgcatcgtggacttccagcagaagcagggcctgag

SEQ ID NO: 140634 - DNA, 395 bp, Homo sapiens
  Payload ID: 7580
  Gene Symbol: HK3
  Gene Name: hexokinase 3 (white cell)
  ENST ID: ENST00000514058
  CDS Start-End: 1-395
ggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcgcttccacgttgtctggcctctctgcaggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccc

SEQ ID NO: 140635 - DNA, 547 bp, Homo sapiens
  Payload ID: 7580
  Gene Symbol: HK3
  Gene Name: hexokinase 3 (white cell)
  ENST ID: ENST00000504910
  CDS Start-End: 1-174
actgactttgcaggccttaggaatttgggaagtgggcagagggctctggtcttgccagctgcatggctttctgtgacctgcttgccctccagagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgag

SEQ ID NO: 140636 - DNA, 3689 bp, Homo sapiens
  Payload ID: 7581
  Gene Symbol: HKDC1
  Gene Name: hexokinase domain containing 1
  Uniprot ID: Q2TB90
  ENST ID: ENST00000354624
  CDS Start-End: 134-2887
atttagtccgcaacacctcgctccccaggaggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatctggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctattaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaataaactttgca

SEQ ID NO: 140637 - DNA, 1733 bp, Homo sapiens
  Payload ID: 7582
  Gene Symbol: HEXDC
  Gene Name: hexosaminidase (glycosyl hydrolase family 20, catalytic domain) containing
  Uniprot ID: Q8WVB3
  ENST ID: ENST00000327949
  CDS Start-End: 12-1472
gaaatattgaaatgtcaggttccactccatttcagatgagattagttcatttagaccttaaaggagctccaccaaaggtctcgtacctctcagagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtga

SEQ ID NO: 140638 - DNA, 2285 bp, Homo sapiens
  Payload ID: 7582
  Gene Symbol: HEXDC
  Gene Name: hexosaminidase (glycosyl hydrolase family 20, catalytic domain) containing
  Uniprot ID: Q8WVB3
  ENST ID: ENST00000337014
  CDS Start-End: 475-2232
gtcgggccaggccccgccccatcagccccagtcccgcccactccatggccctgtccgccgccgcagcgcgcgcccttcccctcctcaccgctacctgctccggttccggcgctcggccgctccgttgccctcgggcgccttggttgcggccctccgctgaggagccatcggaccaggccgccgcggagccgggccggacgcgggcgccaggcccggggacgaacgccgtaacagggagcgcgaggcaggcacggcgcagggacgcgagtgcgacgcgctcggccatcggcccctgggctggcggccaggcccgagcaatcggcggccgagcggggcggggctcagagcggaggcggcggccgcgagggcggggcggccgggcctggctgcgcccccggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttaggcaagcaccctgcagccctccctgtccccttcttcccctccccttcccccgcccgtggagacagctgttctcagcagggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtga

SEQ ID NO: 140639 - DNA, 853 bp, Homo sapiens
  Payload ID: 7582
  Gene Symbol: HEXDC
  Gene Name: hexosaminidase (glycosyl hydrolase family 20, catalytic domain) containing
  ENST ID: ENST00000578130
  CDS Start-End: 1-645
cacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtga

SEQ ID NO: 140640 - DNA, 779 bp, Homo sapiens
  Payload ID: 7582
  Gene Symbol: HEXDC
  Gene Name: hexosaminidase (glycosyl hydrolase family 20, catalytic domain) containing
  ENST ID: ENST00000578775
  CDS Start-End: 1-231
ggcctcctcattgagtatgaagacatgtttccctacgagggccctctgaggctgctgagggccaagtacgcctacaggctggagtgcagtggtgcgatcttggctcaccgcgaactctgcctcccgggttcaagtgattctcctgcctcagcctcccgagtagctgggattacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccc

SEQ ID NO: 140641 - DNA, 638 bp, Homo sapiens
  Payload ID: 7582
  Gene Symbol: HEXDC
  Gene Name: hexosaminidase (glycosyl hydrolase family 20, catalytic domain) containing
  ENST ID: ENST00000580235
  CDS Start-End: 286-638
gcggccgcgagggcggggcggccgggcctggctgcgcccccggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgc

SEQ ID NO: 140642 - DNA, 873 bp, Homo sapiens
  Payload ID: 7582
  Gene Symbol: HEXDC
  Gene Name: hexosaminidase (glycosyl hydrolase family 20, catalytic domain) containing
  ENST ID: ENST00000582315
  CDS Start-End: 103-246
gcggccgggcctggctgcgcccccggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagaggctggagtgcagtggtgcgatcttggctcaccgcgaactctgcctcccgggttcaagtgattctcctgcctcagcctcccgagtagctgggattacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggccc

SEQ ID NO: 140643 - DNA, 1820 bp, Homo sapiens
  Payload ID: 7582
  Gene Symbol: HEXDC
  Gene Name: hexosaminidase (glycosyl hydrolase family 20, catalytic domain) containing
  ENST ID: ENST00000577944
  CDS Start-End: 96-1730
ggcctggctgcgcccccggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctggctctccgcagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcag

SEQ ID NO: 140644 - DNA, 862 bp, Homo sapiens
  Payload ID: 7582
  Gene Symbol: HEXDC
  Gene Name: hexosaminidase (glycosyl hydrolase family 20, catalytic domain) containing
  ENST ID: ENST00000578616
  CDS Start-End: 1-267
gcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcgtgtcccttgcccacggccccatccgccacccgtgactggggcacttccctcctgccctctggccgtcagcctcttgcagcaagcatttccatgaacaccaagtcggagattcgtccacgctggtgcctgcaggcctcatgggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagct

SEQ ID NO: 140645 - DNA, 582 bp, Homo sapiens
  Payload ID: 7582
  Gene Symbol: HEXDC
  Gene Name: hexosaminidase (glycosyl hydrolase family 20, catalytic domain) containing
  ENST ID: ENST00000578632
  CDS Start-End: 348-582
atgtccggcagttcatcccaactgtcagctggggctccttagttctcctgcatgtgtgtcatccaggaggcctagcatgtgcctgtagtcccagctccttggaaggctgaggctggaggatcacttgagcccaggagttgggtgctgcagcgagccatgatcatgccagcacgctccagcctgggcaacagagtgagaccccatctgttaaaaaaaagagagaggccgggcacagtggctcacacctgtaatcccagcattttggaaggccgaggggcagattacctgagatttttcctctgttccgtgcgctaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctgg

SEQ ID NO: 140646 - DNA, 553 bp, Homo sapiens
  Payload ID: 7582
  Gene Symbol: HEXDC
  Gene Name: hexosaminidase (glycosyl hydrolase family 20, catalytic domain) containing
  ENST ID: ENST00000581482
  CDS Start-End: 80-220
cggacctcgcgggaccgcggcggcgcaggaagaagtccccaaggagacttcgccataggagttcacaggaaatattgaaatgtcaggttccactccatttcagatgagattagttcatttagaccttaaaggagctccaccaaaggtctcgtacctctcagaggtgcaaacggcctcctcattgagtatgaagacatgtttccctacgagggccctctgaggctgctgagggccaagtacgcctacagcccctctgaaatcaaagagatcttgcatctggctggactcaatgagctggaggtgattcccttggtgcagacatttggacacatggagtttgtgctgaagcacacggccttcgcccacctgcgggaggtgggctccttcccctgcaccctgaacccccacgaggcagagtccctggcgctggtgggcgccatgattgaccaggtcctggagctacacccaggcgcccagcggctgcacatcgggtgtgatgaggtctattacctcggagagggggaggcctcgcgccggtggctacagcaagagc

SEQ ID NO: 140647 - DNA, 1824 bp, Homo sapiens
  Payload ID: 7582
  Gene Symbol: HEXDC
  Gene Name: hexosaminidase (glycosyl hydrolase family 20, catalytic domain) containing
  ENST ID: ENST00000582429
  CDS Start-End: 1-1085
ggctgcacatcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggtatgtctggtctggccaccccaagccccaccggcccctccccgaaagacccggagggcaggaggccaagcacccagtgctccaaccaccctgctggactgtggtggtcctcacagtcggaggatggtctcaccgccccagctcagccacccacctgccctgaagtccacccaggctgggcctgtgtctgggtctccaggcctaagcccaaagcaggctggagagtgacgcgggaggcacccctcagacacagtgaatccgcagaaatgcacgcaggtcggaggtggggaacggctccacctttgctgcacacacgtcctgcccacctggccgagcaggtgtggggctcaggcgcccggccctggaaggccccgcaccctggacccagcactcacacttccaggtctcctgagggagcagcgggacccatgggcaggggcaggcaccggggaaccccttggggtcggcagggggcttggccagaggagctgtgtgtgtggaaactcgcaggccacacgggaaattagcgactgcgtggtgctgatgcagaaagaaaaatggccgagacgcgcggagagcgggacccgcaggcgcggcggcccagggacggggacgcggccggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagacta

SEQ ID NO: 140648 - DNA, 686 bp, Homo sapiens
  Payload ID: 7582
  Gene Symbol: HEXDC
  Gene Name: hexosaminidase (glycosyl hydrolase family 20, catalytic domain) containing
  ENST ID: ENST00000583354
  CDS Start-End: 1-241
gggaacggctccacctttgctgcacacacgtcctgcccacctggccgagcaggtgtggggctcaggcgcccggccctggaaggccccgcaccctggacccagcactcacacttccaggtctcctgagggagcagcgggacccatgggcaggggcaggcaccggggaaccccttggggtcggcagggggcttggccagaggagctgtgtgtgtggaaactcgcaggccacacgggaaattagcgactgcgtggtgctgatgcagaaagaaaaatggccgagacgcgcggagagcgggacccgcaggcgcggcggcccagggacggggacgcggccgtgtcccttgcccacggccccatccgccacccgtgactggggcacttccctcctgccctctggccgtcagcctcttgcagcaagcatttccatgaacaccaagtcggagattcgtccacgctggtgcctgcaggcctcatgggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctacc

SEQ ID NO: 140649 - DNA, 5252 bp, Homo sapiens
  Payload ID: 7583
  Gene Symbol: HEXA
  Gene Name: hexosaminidase A (alpha polypeptide)
  Uniprot ID: P06865
  ENST ID: ENST00000268097
  CDS Start-End: 505-2094
atttcacatcacaacgacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgaacagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggcactgtggtagtgggtttttttgttgtttttgtttttgagactgtctcaaaaactctgtcgcccaggctgacagtgcagtggcacaatcttggctcactgcagcctctgcctcctgggttcaagcgattctcgtgcatcagcctcctgagtaactggaattaataggcacgtgccaccatgtccatctaattcatatatatatattttttttttctgagacggagtctcactgtcacacaggctggagtgcagtggcacgatctcgactcactgcaagctccacctcctgggttcacgccattctcctgcctcagcctccccagtagctgggactacaggcgcccgccaccacgcccggctaattttttgtatttttagtagagatggggtttctccgtgttagccaggatggtctcgatctcctgacctcgtgatccgcccgccttggcctcccaaagtgctgggattacaggcgtgagccaccgcgcccggccgaattcatctatttttagtagagatggggtttcactatattggccaggctggtcttgaactcatgacctcagatgttcacttgtcttggcctcccaaagtgctgggattagaggcgtgagccaccgcacgcgggcctgtggtaaattgttgaatttgaaggactcagaggccctggtcaattccaaaataacgtaggcgacttccatccccctcctcccaaccattttcagcccaaagcatcttcgcagggaatggatggctgcgcggaggtgggcggtggctctggagagggtctttgcaggtgtgattttctctagaaggaaatgtctcgtcgtggacccagactgccccctcctggtttcagatgcagaagtgatactgtaagccagaggcgggggcagtaatgcatcgcagccattttaggtgaggatttccttggcggttatttgttaagttctttggctgggccctgggctggggtaacaatggacaggttccaggcatttttttcagaaagcttccagtgtagtggatacagaaacttcaggaaggcagggctgagaaggatctgagtaaaactcggtccttcaacaccatccttcagcccctgggtcatgttccttcgaggtcctggtgggaggtagacaagcctagccttgtgctgttcctgtaaggacagggtgggcattttctaccaacagaattcttggaattttcacacagcccagcctagccaagtccagggctatagcccagatacacaagttaaggtcccagcactggcacccaccacaggagcccccttacctctattacccagaagcttgtaggaggggtggtccgcagacaaggaccctgcacaggtgcgaccctgcttccctcctggtcataactttcatgttactattgcttgggataatgttaagtaaaaatagcagacactgagttttaagtctcaagtggatgaaggcagagatcgtgatacacttgagttaaagcagtagggttctgtcattttctattcctgttgtaaacattttctttaatgttattatttttaccactaaactaacgtggcctggtcacgactttcattggtaaagtgtgctgttcctcaccctccaccgttgctcctttggtccactgatcataagagcatttacctgaaggtcgtcagacctcgaatgccaacaggtcaactgcagtggcctgcagttaccacccagtctgttccaatgaacagaatcgctgttgccccaactcatctcccttcacctaggctgtaaattgaaagtcccacccctgagcggaacacaggccatcttgtgtgctgtgcaccaccagggggtggggaagtttccagactgacttcctggctccagtcatcctaggaaaagagttctccagtcgctccccacccccaccccttcccattccaggagtctattaaggaggcaaagcaggcctaacgggtatcaaagcaaaggagtgaatggagactgggagagtcttcaacctctcctctccttggtaggagctgaggctgcatgccaggtaccttcccttcgaggaatctaataaagctaggtcactggtgttttcaggtgcttctcaaaggattgccgtaggggtaggatatcaggatgtgggagcacaggtgccaccacagcactagtgatggagagtcattgcccctagacttctgggacagtgagactgtgaggaaagctgaaatgatactgggaaagggtgaaagaaaggatgtaggtggaatttatttagtattaatgtaggtacacataccttatggcaacattcctagcactctaaattctagatttgtatagtttctgtcaatatcttttgtaagcttaatcaatacagggcatgacaagtatgtgtcacatacttttttttccacgaagaaaaaaaataagtaggaattgggtgctttgtttatcaaaatttgtatttcctttataaataaactttgaaataaaggttgaaaattagtatcttt

SEQ ID NO: 140650 - DNA, 1795 bp, Homo sapiens
  Payload ID: 7583
  Gene Symbol: HEXA
  Gene Name: hexosaminidase A (alpha polypeptide)
  ENST ID: ENST00000566304
  CDS Start-End: 22-1644
gagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggttggccgcaccaagcttaccctgtcttcctagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgct

SEQ ID NO: 140651 - DNA, 1743 bp, Homo sapiens
  Payload ID: 7583
  Gene Symbol: HEXA
  Gene Name: hexosaminidase A (alpha polypeptide)
  ENST ID: ENST00000567411
  CDS Start-End: 32-463
agccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgagttctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagta

SEQ ID NO: 140652 - DNA, 1174 bp, Homo sapiens
  Payload ID: 7583
  Gene Symbol: HEXA
  Gene Name: hexosaminidase A (alpha polypeptide)
  ENST ID: ENST00000563762
  CDS Start-End: 1-267
atgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagcaaacatgtactgaatgactgctgtgtgtcaggcactgggaatacaaagacactgagattggtccctcctgttgaggaactcacaacctagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggaagtccaacccagagatccaggactttatgaggaagaaaggcttcggtgaggacttcaagcagctggagtccttctacatccagacgtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcct

SEQ ID NO: 140653 - DNA, 1582 bp, Homo sapiens
  Payload ID: 7583
  Gene Symbol: HEXA
  Gene Name: hexosaminidase A (alpha polypeptide)
  ENST ID: ENST00000567159
  CDS Start-End: 22-1551
gagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagca

SEQ ID NO: 140654 - DNA, 1397 bp, Homo sapiens
  Payload ID: 7583
  Gene Symbol: HEXA
  Gene Name: hexosaminidase A (alpha polypeptide)
  ENST ID: ENST00000566672
  CDS Start-End: 32-463
agccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttcttt

SEQ ID NO: 140655 - DNA, 1351 bp, Homo sapiens
  Payload ID: 7583
  Gene Symbol: HEXA
  Gene Name: hexosaminidase A (alpha polypeptide)
  ENST ID: ENST00000569410
  CDS Start-End: 4-1125
gccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctg

SEQ ID NO: 140656 - DNA, 1353 bp, Homo sapiens
  Payload ID: 7583
  Gene Symbol: HEXA
  Gene Name: hexosaminidase A (alpha polypeptide)
  ENST ID: ENST00000567027
  CDS Start-End: 1-955
ctttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataac

SEQ ID NO: 140657 - DNA, 674 bp, Homo sapiens
  Payload ID: 7583
  Gene Symbol: HEXA
  Gene Name: hexosaminidase A (alpha polypeptide)
  ENST ID: ENST00000568260
  CDS Start-End: 1-386
ggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattgcatccctgttccctttgccaggagaagacttctttcatctttctgctgtggaaactgacccatgagataccctgaccataaatgatgaccagtgtttactcctctctgagactgtctggggagctctccgagttctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaagg

SEQ ID NO: 140658 - DNA, 1000 bp, Homo sapiens
  Payload ID: 7583
  Gene Symbol: HEXA
  Gene Name: hexosaminidase A (alpha polypeptide)
  ENST ID: ENST00000567213
  CDS Start-End: 18-377
ggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtctttctctgtcattcagactggagtgcagtggtgtgatcacggcttacagcaacctcgaactccaggactcaagcagtcttcccgcctcactgatgagtagctaggactacagacgcatgccaccgcacccagctaatttttttattttttgcattttgtagagatgggggtcttactgtgttgcccaggctggtcttgaacccctggcttcaagcgatcctcttgtctcggcctccccgagtgctgagattacaggtgtgagccaccatttattacctaaagcatgatacttttctagtatccctgtatagtactgagtccaagaagctaaacttgatcaaggtgtatgtgggtagcctgggcctggtttatgaaaaatttgagttttatttctgtgagctgtaggtgttcccctgctttggatattctgtttgaacacagtatacattggaggactcaggatgtggaacatgattcattcaggagtcagctgagaaagtgtttattaaccccttaactctgtgccttcagactaattgcctaatttccaagctgttgctgctacttccttttttttttttttttttttaactctgcctgccttccagacatttccgaggataacaagaaaatagttatgaatgttttttcagtctttaagggagggtataatagtgggaagaacttggtgattttaaaaataaaacaataaaaattaaaagtccaa

SEQ ID NO: 140659 - DNA, 1901 bp, Homo sapiens
  Payload ID: 7584
  Gene Symbol: HEXB
  Gene Name: hexosaminidase B (beta polypeptide)
  Uniprot ID: P07686
  ENST ID: ENST00000261416
  CDS Start-End: 118-1788
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctcttggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 140660 - DNA, 720 bp, Homo sapiens
  Payload ID: 7584
  Gene Symbol: HEXB
  Gene Name: hexosaminidase B (beta polypeptide)
  ENST ID: ENST00000513336
  CDS Start-End: 1-607
gaatacaacatacagcttccttactacatttttcaaagaaattagtgaggtgtttccagatcaattcattcatttgggaggagatgaagtggaatttaaatgttgggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 140661 - DNA, 604 bp, Homo sapiens
  Payload ID: 7584
  Gene Symbol: HEXB
  Gene Name: hexosaminidase B (beta polypeptide)
  ENST ID: ENST00000505859
  CDS Start-End: 1-158
tggatgcaactaacctcactccaagattatggcctcgggcaagtgctgttggtgagagactctggagttccaaagatgtcagagatatggatgacgcctatgacagactgacaaggcaccgctgcaggatggtcgaaggcctggcatctttcttgtgagacaagcttaaggacacaaaagaaacacaactttgtgataccactcttctgaaggctacttatagtaataacttcatagatgaacagcatgattcaggttactgattgtctattcattggcatataatatcccctgaattaagaagaatatgtacttttcagttacaaagtacctaccataatttctgctaagggaacaaatccaataacaactttgttgtcctggcgagtctgaatttcctgaatgtttcctcttctttgtgccagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaatacagcctagagctcatacaaaaagacataa

SEQ ID NO: 140662 - DNA, 806 bp, Homo sapiens
  Payload ID: 7584
  Gene Symbol: HEXB
  Gene Name: hexosaminidase B (beta polypeptide)
  ENST ID: ENST00000509579
  CDS Start-End: 586-693
tgccaagaggtagaaattaaaggtaggcatggtggtcacagtccactaaaaaactagtattccaacttctattccctggcacactactaaataggcaaccagggatttaaaaaatggtttctggtgtccaggtaagtttgcataaaaccaaaataaaactgtttaatactggcccactacattaatctatggtgctaacacgtgctgtgaaccgtgggtcagggctggggataaagtttgcaaccatttttttggggggtgggggaagaggaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 140663 - DNA, 2021 bp, Homo sapiens
  Payload ID: 7584
  Gene Symbol: HEXB
  Gene Name: hexosaminidase B (beta polypeptide)
  ENST ID: ENST00000511181
  CDS Start-End: 913-1908
gtatccttagctcggctcctcgcttccccagcggctcgccccagacattgcaccgcggaggggaggccggtcgacctctccggcgatgcccggcttctgcctgctgtgggagggcagcggcgggcaccgtgatctccgcaccgagaagagctccccttgccctctagtcgaagctcccgagtgctcggagcacgctcacccctcgcgaacacacccctgcagccgaagcagcccctgaagcccgcagcgcctgcaacaggtccggggcagtgggggaaacttacagcagtggcgactggccgcaacgcacaactgagttctagcgacggtcacgggcaaggaggcgacgaaccggtcgtctcagcccagggaagcggtggcgaatgccccggagaaaggagggccagccggggagaggactgcgccccgaacgatggctcgcggaccggctaccgatggcgttcgcctccgtctgtcgtccccacgccgcggacccggtgtccaggacccgcagagcgtctccggagcgcgtcacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 140664 - DNA, 756 bp, Homo sapiens
  Payload ID: 7584
  Gene Symbol: HEXB
  Gene Name: hexosaminidase B (beta polypeptide)
  ENST ID: ENST00000503312
  CDS Start-End: 1-511
ctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaaggcctggcatctttcttgtgagacaagcttaaggacacaaaagaaacacaactttgtgataccactcttctgaaggctacttatagtaataacttcatagatgaacagcatgattcagatctgccaggacagggctgagataatctctagctactgtaacctcaagattcatcagaggctccaaaacttgcttatcagctttcttcagagcctaaagaaattaaagaatgttaacttatctttcataaataaaaacttaaaataaa

SEQ ID NO: 140665 - DNA, 9146 bp, Homo sapiens
  Payload ID: 7585
  Gene Symbol: H6PD
  Gene Name: hexose-6-phosphate dehydrogenase (glucose 1-dehydrogenase)
  Uniprot ID: O95479
  ENST ID: ENST00000377403
  CDS Start-End: 303-2678
gtcttgctgagcgcaaggcggtggaggcctgaggcctgaggcctggggcggggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtaaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaa

SEQ ID NO: 140666 - DNA, 5590 bp, Homo sapiens
  Payload ID: 7585
  Gene Symbol: H6PD
  Gene Name: hexose-6-phosphate dehydrogenase (glucose 1-dehydrogenase)
  ENST ID: ENST00000602477
  CDS Start-End: 153-2561
accagaaaacgctctgcggctagagcttcagcacaggctgggtctgctgtgccgggtctgtatggggacagctgcacgcctcttccgcttgtgtgagaacaaaggccggaacctggattctgatccaaaccccctggcccccaccttctgggatgttagcagagccttttaactggcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaa

SEQ ID NO: 140667 - DNA, 4931 bp, Homo sapiens
  Payload ID: 7586
  Gene Symbol: HFM1
  Gene Name: HFM1, ATP-dependent DNA helicase homolog
  Uniprot ID: A2PYH4
  ENST ID: ENST00000370425
  CDS Start-End: 100-4407
agccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaagaggtaacagaaaatggtttaggttccttgaaggctgtcacagaaattccggcaaaatttagaagtattttcaaagaatttccatatttcaactatatacagtccaaggcctttgatgatcttctttacacagataggaattttgtgatttgtgctccaactggttctggaaaaactgtagtgtttgaactagctataacaagattgttaatggaagtaccattgccatggttgaatattaaaattgtttacatggcaccaataaaagccttgtgcagtcagcgttttgatgactggaaagaaaaatttggaccaataggattgaattgtaaagaacttactggagatacagtaatggatgatctatttgagattcagcatgcccatattattatgacaactccagaaaaatgggatagcatgactaggaaatggagagacaactctttggttcagctggttcgactgtttctcattgatgaggtacatattgtaaaagatgaaaatcgtggtccaactcttgaagttgtagttagcagaatgaaaactgtacagtctgtttctcagactttaaaaaataccagcactgctattccaatgcgatttgtagctgtatctgcaacaattccaaatgctgaggatattgcagaatggctttcagatggtgaaagaccagctgtgtgtctgaaaatggatgagagccatagaccagtgaaacttcagaaagtggtccttggatttccctgcagtagtaaccaaactgagtttaagtttgatttaaccctcaactacaaaattgccagtgttatacaaatgtactctgatcagaaacccacacttgtgttttgtgcaacaaggaagggtgtgcaacaggctgcttctgttcttgtgaaagatgctaaatttattatgactgtggaacagaaacagaggttacagaagtatgcatattccgtaagagattcaaaactgagagatatcttaaaagatggtgctgcttatcatcatgctggtatggagctgtcagatagaaaagtagttgagggagcttttactgttggagatttaccagttctttttactaccagtactttagctatgggagtaaatttgcctgctcacctagtagttataaaatctacaatgcattatgctggaggactgtttgaagagtacagtgaaacagatattctacagatgattggtagagctggtcgacctcaatttgacactacagctactgcagttatcatgactcgattaagcacaagggacaagtacattcagatgttagcttgtagagacactgtagaaagcagtttgcacagacatcttattgaacatttaaatgcagagatagtactgcataccatcacggatgtgaatattgctgtggaatggatacgatcaactctgctttatatcagagccttgaaaaatccatctcattatggttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcaggatttggaaacactttgagttcaagtaccaggggaagtaagctaccccttcaagagtcaaagagcaaattccaaagagaaatgtcaaacagttttgtttcatcacatgagatgtcggatatttctttatcaaattctgctatgcccaagttcagtgcatcctccatgacaaaattacctcaacaagccggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggatttttttctcctgtatttgattagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagta

SEQ ID NO: 140668 - DNA, 1928 bp, Homo sapiens
  Payload ID: 7586
  Gene Symbol: HFM1
  Gene Name: HFM1, ATP-dependent DNA helicase homolog
  ENST ID: ENST00000430465
  CDS Start-End: 1-1877
gaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagataccgcaaagattttcagacatggctcccgaattacaagatgtataacattgtcaaatgcaatcgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcaggatttggaaacactttgagttcaagtaccaggggaagtaagctaccccttcaagagtcaaagagcaaattccaaagagaaatgtcaaacagttttgtttcatcacatgagatgtcggatatttctttatcaaattctgctatgcccaagttcagtgcatcctccatgacaaaattacctcaacaagccggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcaggtaagaactctttaaagacactttaagattatatcaataaaaaacttttcacaaa

SEQ ID NO: 140669 - DNA, 672 bp, Homo sapiens
  Payload ID: 7586
  Gene Symbol: HFM1
  Gene Name: HFM1, ATP-dependent DNA helicase homolog
  ENST ID: ENST00000427444
  CDS Start-End: 84-672
gataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaagtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacctgagaagagtgttcctgatgatacaaaattagttaattttgcagaagataaaggagagagcacatcagtattccggaaaagattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcac

SEQ ID NO: 140670 - DNA, 540 bp, Homo sapiens
  Payload ID: 7586
  Gene Symbol: HFM1
  Gene Name: HFM1, ATP-dependent DNA helicase homolog
  ENST ID: ENST00000448819
  CDS Start-End: 87-540
ggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaattatttaaaatatctgacaatatacatgggagtgcttattctaatgacaatgaattggactctcacattggctcagtgaaaattgtacaaacagaaatgaacaaagggaaatcaaggaactatagcaatagtaagcaaaaatttcagtattctgcaaatgtgtttacagcaaataatgctttttctgcttctgaaatcggagaaggcatgttcaaagcaccatctttttcagttgctttccaacctcatgatattcaagaggtaacagaaaatggtttaggttccttgaaggctgtcacagaaattccggcaaaatttagaagtattttcaaagaatttccatatttcaactatatacagtccaaggcctttgatgatcttc

SEQ ID NO: 140671 - DNA, 596 bp, Homo sapiens
  Payload ID: 7586
  Gene Symbol: HFM1
  Gene Name: HFM1, ATP-dependent DNA helicase homolog
  ENST ID: ENST00000455133
  CDS Start-End: 183-596
aagtggggacccagccgagccgtccgggcagcggtcgatctctagagccgtctgccgggcaggcagcggacgggcgcggcgagttgttggtcaccaggcgtctccaggccgccggcccgcgccagcgcctcagccgcatttccagtcagaaagcgatttatgacaaagtccagttttcaacaatgctgaaatcaaatgattgcctgttttctttggaaaatttgttttttgaaaaaccagatgaagttgaaaaccatccagacaatgaaaagtcattggattggtttctccctcctgctccattgatttcagaaattccagatactcaggagttagaggaagaattagaaagtcataaactgttaggtcaggaaaagaggccaaaaatgttaacatcaaatttaaagataactaatgaagatacaaattatatttcactaacacaaaaattccagtttgcctttccttctgataaatatgaacaggatgatctaaatttagaaggggtaggtaataatgacttatcacatattgctggcaagctgacatatgcttctcagaaatataaaaatcacattggcactgagatagcacct

SEQ ID NO: 140672 - DNA, 2159 bp, Homo sapiens
  Payload ID: 7587
  Gene Symbol: HGFAC
  Gene Name: HGF activator
  Uniprot ID: Q04756
  ENST ID: ENST00000382774
  CDS Start-End: 116-2083
ggcccgcctgacgtgggaggcagccagggttaatcatttccacgaagccttgaccccacctgccttggccgctctgctcccgcctcccactgcccctcaggccagctcaggagccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaagaacccggccca

SEQ ID NO: 140673 - DNA, 2016 bp, Homo sapiens
  Payload ID: 7587
  Gene Symbol: HGFAC
  Gene Name: HGF activator
  ENST ID: ENST00000511533
  CDS Start-End: 28-2016
actgcccctcaggccagctcaggagccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgatttggaaactgagggcagagaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctga

SEQ ID NO: 140674 - DNA, 2531 bp, Homo sapiens
  Payload ID: 7588
  Gene Symbol: HGH1
  Gene Name: HGH1 homolog
  Uniprot ID: Q9BTY7
  ENST ID: ENST00000347708
  CDS Start-End: 68-1240
gggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggcatgtgtggaccatgttttcccctggccagagcccccacctgccactggaggccagttgccctcttagcactcagacatcagcactgtcttcacagaataaatgctttatctggccttgc

SEQ ID NO: 140675 - DNA, 2106 bp, Homo sapiens
  Payload ID: 7588
  Gene Symbol: HGH1
  Gene Name: HGH1 homolog
  ENST ID: ENST00000533266
  CDS Start-End: 33-290
accggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcatgcaggc

SEQ ID NO: 140676 - DNA, 258 bp, Homo sapiens
  Payload ID: 7588
  Gene Symbol: HGH1
  Gene Name: HGH1 homolog
  ENST ID: ENST00000628266
  CDS Start-End: 1-258
atgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcagactcgggcctggagcggctggtgcgcgcgctgtgcacgcccggctacaacgcccgcgcgcccctgcactacctag

SEQ ID NO: 140677 - DNA, 7390 bp, Homo sapiens
  Payload ID: 7589
  Gene Symbol: HHIPL1
  Gene Name: HHIP-like 1
  Uniprot ID: Q96JK4
  ENST ID: ENST00000330710
  CDS Start-End: 99-2447
agggaaggggagcgcccgccccttccctgccgccgcgagcgccccgggaggggaccggggctgccgtccctccgcctcttcccccgcggggcgtagcgatggcccgggccagggccggggcgctgctggcgctttgggtgctcggggccgccgcgcatccgcagtgcctggacttcaggccgcccttccggccgacgcagccgctgcgcctctgcgcgcagtactcggacttcggctgctgcgatgaggggcgcgacgccgagctgacccgccgcttctgggccctggcgagccgcgtggacgccgccgagtgggccgcgtgcgccggctacgcgagggacctgctgtgccaggaatgctcgccgtatgcagcccacctctatgacgccgaggacccattcacgcccctgcgcacggtgcccgggctctgccaggattactgcctggacatgtggcataagtgccgggggctgttccgtcacctgtcaactgaccaggagctctgggcgctggagggcaaccttgccaggttctgccgctacctgtccctggatgacacggactactgcttcccttacctgctggtcaacaagaacctcaactcaaacctgggccacgtggtagccgatgccaagggctgcctgcagctgtgcctggaggaggtggccaacgggctgcgcaaccccgtggccatggtccatgccagggatggcacccaccgcttcttcgtggccgagcaggtggggctggtgtgggcctacctgcccgaccgctcgaggctggggaagcctttcctgaacatcagccgggtggtgctcacctcgccctgggagggtgacgagcgtggcttcctgggcattgccttccaccccagcttccagcacaaccgcaggctctacgtctactactcagtgggtatccgcagcagtgagtggatccgcatcagcgagttcagagtctccgaggatgacgagaacgccgtggaccacagctctgagaggataatcctggaggtcaaagaaccagcctcaaaccacaacgggggccagctgcttttcggggatgacgggtacctctacatcttcactggagatggcgggatggccggagacccctttgggacatttggaaatgcccaaaacaagtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcaatgacttgctgccgattttcgcctacccgcacacggttggcaagtcggtcacagggggctacgtgtaccggggctgcgagtaccccaacctgaacggcctctacatttttggggatttcatgagcgggcgtctgatgtccctccaagagaacccagggacaggccagtggcagtacagtgagatctgcatgggccacggccagacctgtgagttcccaggcctcatcaacaactactacccgtacatcatctccttcggggaggacgaggccggggagctgtacttcatgtcgacaggggagccgagtgccacagctccacgcggagttgtctacaaaataattgacgcatccaggcgggcaccacctggcaaatgtcagatccagcctgctcaggtgaagatcagaagccgtctcatcccctttgtgcccaaagaaaagttcatcccgaagacacggagcaccccgcggcctacagcgcgggcgcccacgcgggcgccccgccgagggcgccccacggccgctccccccgcgccaaccccgcggccagcgcggcccacccagcagccagggagccggaggggcggcgggcggcggcgggggcggctgaactcggcgagccgggcgttccgggatggcgaggtgcgcctggtgcggcccgcgggcctgagctctggcagcgggcgcgtggaggtgttcgtgggcggacgctggggcaccgtgtgcgacgactcctggaacatcagcggcgccgccgtcgtgtgtcgccagctggggtttgcctacgccgtgcgcgccgtcaagagagccgagttcggccagggcggctcgctgcccattctgctggacgatgtgcgctgcgcgggctgggagcggaacctgctggagtgccagcacaacggcgtgggcacccacaactgcgagcacgacgaggatgcgggcgtcgtgtgcagccaccagaaccccgacctgtaggcaacacgccgctgccccaggccatcccgccggcgggggagcctggcaggggccgctccgccctgtgtgcgcccagcgggtgcacacgtgttctagagtgaagggggtgcgggtgtgtgctgtcctggggacatgtgtgaggcgctgcagtgcatgtgtgtcctctgcagacccaaggcaggagtgtgtgttgggggcggtgtgggctctggaagtgcatggtccatcatgggcgggaggagttcctttcttacctccaagcgtttcagacaccagcaggaacagcagccgggctgtgggaccctgaggagggagggcagccaggcttcgaggacggacatggcccctggctgtgctaacagaggcacagcttgcagactgagggcggtggggagaaccaggcttgtcctgcccacagctggaatggaaggtgcaagaacagccggagggtggcctgaggaatgtggcccggacagcatggcctggtgcccgcatcccccccaccccctggcagtcagaggcgctggagagaaccggaaggcatccagtggggaagggaaagccttctggaaggtgggagcagggtgagctgcaggcctggggccccactggaggggcaggctgcgtggaggagccagcacctgctcagggaggatggctgtgaggactggatgacctccaaggccgtatgctggagaagccactcagcagcatactcagtccttgtgggtgctcctgggatgggaccagcctcctccaaccctgaggcctgattctctcttgctcttggggcagaagccacccacactagctgggcagagctttcaccctggccctccagtgagtcggtgggcctccactactttcaaagctgtgtttgggccctggggccacctctgtcctttccatccccatccctgctcagtgtaaacccaggagacctgattcctccagccctacctcggggctgaccaggctgggggtccagtgaaactactgacactttttcacccagggctatgccaataatgtggctgtttacacaccactttcctgcctcctctctgacctgcacctgtgtgggagccggggtgggaaccaggagaaaggggtgaggcctcccgcttcccacctgcatcacaggtggaagctccttcactccagggatgctcggccctggctctgtgccaggccgcagaggggcacttagtatgactgcgctcagcctcggatgggagcacgggtggggggtgggtaagcagatgagtcaccaggcagtgaagacaggatgtggcccatgtcgggggttggaagaggtctgggtggggcacccaaacccaacctatgggggggctttgggagggggtgatgctgtgccaagttctgggagctggcaccaggggtggctgggcaggccttggggcaggcatgagtctggcagggtctcctagctgctagtatagggtctcctagccactagtataggatcctgggctgcagcagaaagctttaggtcactgtcttggactcctcatactctgtgctttacagaatgggaaactgaggcacacagaggttagatatcttagggcaccaagccagggaagggagaagtcaagtttgaatacagcagcttagtttagagtccccgcaccctaaccactgccctccccagctacactatgcctgcagagagcggtgtgctggggctcctgcctggtgtgggagtgccagcctggctgggaagcagctgatggagatccctgggggctcctcttgcctggcaggtgcccccgctgctggcctcatgctcctctcgggcctccagtggcccaggggaggttgagtgggcatcttcctgggatgcaggggagttctgagctctgacgccgggcgtgttaggagatagcaggccgttaatgaccatcccagccgaattcctcactgtgcagatgaggaagtgagctcagggaggctgagtgtcccaggcctgttgccagatgaggccacgctgagactggagccagggaaggtgcagcaagccttgaggccctcaagaatgcagccgagccagggccctgcttgcctggccccagaagctgttttgctcagagctggattaggagggttggcaaagggagctctgggtgcggcctcaggccctccagtacttctctgggcagttcgggctttggccttcagtcttccaggccaggcgctcttcctccccagcctccaactcatcacctctcaggccccaaaccaggcctgggctaggctgcagcctgcctcctggggactcactccacagtccccaggtcagtggtccccaacctttttggcatcatggactggtttcatgtaagacaatttttccatggatgggggttggggggatggttttgggatgaaatgtcccacctcagatcatcaggcattagattctcataaggagttcacagcctagatccctcgcatgcacagttcatagtaggtttcatgttcctatgcggatctaatgccactgctgatctggcaggaggcagagctcaggtgggaatgcttgctccccacactaccctgccccactgccactcacctcctgctgtgtggcccggttcctaacaggccacccatcagtactggtccgtggcccagggtttggagacctctgccctaggtagtaataagagtggacagctgttatatgtaaatacttgttccccgatgctggaaagaaatagcactaaaacataaatttaattctttcagcaaggcaattttactttctgcagaaagggtgctcatcgcagatggaacaatagtgagaggacacctgaacaaaggagggaagcaattgttagcccttatgcagtttgtccctgctactgtgtcctatgtccattggcagaagccagaccgcacaatctaaactaaaacccgattggctgtttaaaatttttctaaataggtaaaagtaatggaaggataaaggaaaagaggaagttgcttacgaaaggacttagaaaagtaataatattcccaaataaggaaggggtataggctgtgagctgggacatgcctgtgagcacgtccagcacagatatcttggttaaagtataaggacatagaacgtactatgtgcctgtgagcacgtctaacagttacatagaatagggcttgacaaagagttattagcataaagcaaggaggtttgaaggaagttcgtctttaaaagaaaccattatttctaacacttacgatttattctttaacaagaagggaaactttcaagaggaacttttactttctacaacagctgacctctgctgagcgcttactacatgccaagcactgctctgaaagtttaacataccattcactcatgtaatcctcatattaatgcacatttactcacgtggaagccgagttccagggcatttgtcacttaccaaatgtcacatagccaaaatttgaatttgagcccaggtagtccagctctgggaccctgctgtgggccttcctgctgggccacctcaagggcattgaaagccagccccaccccactgggacacaagttcagagaagggcagagctggctgcctgtccagtgcttctttcactccaccacctacagctggccgctgagggagcattcacatgtgactctgtccccagggactccgatcttgccttaaagtcctccagggcctctgaggatgggggcacagccttcaccctcaccccctctaatccaacctctagtcaatagccaggatcagattctcagagaggggctgccctgcccagtgccacacagcttagtgctggagcctcagggtcaatgctgcaggggtggcccagtgtccaggactgtgttcaagacatcagtcagaggtcacaacatcccaggccctagactgagcctaggggtcaccatgttgataccttagaaatgtttgggaggttcaaggaagctggaaactgggttccagtcctggctctgtgcctctctgagtctcattgcaaaatagaggtcaccagaaggattactggatgaaaaatgaggtagcattgcagacgtgcatggcacgtacactctaggttgcttcctagacagaaagctcagttcgaggctggtggcatccatgctggcagcagccaactgtctgcgacagagtgaggaggggcatgccacgtgaaggaccagcatcagaatgacatgggaagaaactctcacaatagcagaagaaagagctccttcagcctaacatgtagaactcaagtcttcttgtcgcgcttctgtcccctcgcccctcctcccccactgagaactagcttttactgagcagttattacatgccagctacctcgggtgtgtcagctcatttaatcttgacaacagctccacgagacaccctcaatatcactgtccctgttttccagatgaggggacagattcctagggtgttatgtaagtggtccccggggctttagaggcaggtttgcaccaaggcccattctcccagagccggatccttctccttccctgggatacagcacctccaccctgccaggccacccatgtaaaggcagccaattcagagccacctcttatgcctgcatctccccaacaattcctgctgggaaaccactcctcgtatggtgtcatctacaccagtgggtttcaagcttgagaagaatcaagttctacagggctgcttaaaacacaggttgctgggtcctgtctctcagagtttttgactcagtcttggttgagaattttcagttctagaagctcctgggtaatgctaatcctcctgttctaggggccatagtcattgtccatactggtgctatccaatagaaacataatgtgagccaaataggtaatttaaaatctgcttgtagccatgttaaaaaagtaaaacaggtaaaattaa

SEQ ID NO: 140678 - DNA, 2241 bp, Homo sapiens
  Payload ID: 7589
  Gene Symbol: HHIPL1
  Gene Name: HHIP-like 1
  Uniprot ID: Q96JK4
  ENST ID: ENST00000357223
  CDS Start-End: 66-1892
cgcgagcgccccgggaggggaccggggctgccgtccctccgcctcttcccccgcggggcgtagcgatggcccgggccagggccggggcgctgctggcgctttgggtgctcggggccgccgcgcatccgcagtgcctggacttcaggccgcccttccggccgacgcagccgctgcgcctctgcgcgcagtactcggacttcggctgctgcgatgaggggcgcgacgccgagctgacccgccgcttctgggccctggcgagccgcgtggacgccgccgagtgggccgcgtgcgccggctacgcgagggacctgctgtgccaggaatgctcgccgtatgcagcccacctctatgacgccgaggacccattcacgcccctgcgcacggtgcccgggctctgccaggattactgcctggacatgtggcataagtgccgggggctgttccgtcacctgtcaactgaccaggagctctgggcgctggagggcaaccttgccaggttctgccgctacctgtccctggatgacacggactactgcttcccttacctgctggtcaacaagaacctcaactcaaacctgggccacgtggtagccgatgccaagggctgcctgcagctgtgcctggaggaggtggccaacgggctgcgcaaccccgtggccatggtccatgccagggatggcacccaccgcttcttcgtggccgagcaggtggggctggtgtgggcctacctgcccgaccgctcgaggctggggaagcctttcctgaacatcagccgggtggtgctcacctcgccctgggagggtgacgagcgtggcttcctgggcattgccttccaccccagcttccagcacaaccgcaggctctacgtctactactcagtgggtatccgcagcagtgagtggatccgcatcagcgagttcagagtctccgaggatgacgagaacgccgtggaccacagctctgagaggataatcctggaggtcaaagaaccagcctcaaaccacaacgggggccagctgcttttcggggatgacgggtacctctacatcttcactggagatggcgggatggccggagacccctttgggacatttggaaatgcccaaaacaagtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcgaccgtggcgacccctcctcgggcactggccgcgggcgcctcttctgcggcgacgtgggccagaacaagttcgaggaggtggacgtggtggagcgcggcggcaactatggctggcgcgcgcgcgaagggttcgagtgctacgaccgcagcctgtgcgccaacacctctctcaatgacttgctgccgattttcgcctacccgcacacggttggcaagtcggtcacagggggctacgtgtaccggggctgcgagtaccccaacctgaacggcctctacatttttggggatttcatgagcgggcgtctgatgtccctccaagagaacccagggacaggccagtggcagtacagtgagatctgcatgggccacggccagacctgtgagttcccaggcctcatcaacaactactacccgtacatcatctccttcggggaggacgaggccggggagctgtacttcatgtcgacaggggagccgagtgccacagctccacgcggagttgtctacaaaataattgacgcatccagctgtaaggccagaagcgccatgcccggctatgtcccagctccttccgtgtgcagctcattgacgtctcagccgttcattttacagtggtggaaatgagcacaaagacacgaagtcatgggcctggggcccagggccagggtggggcccaggccactggctccagagccctgccctaaccccttggctgtgtgccttcacctcaccctcttcaagcaccttccccaacccacgttgccctccaggcctctgtccagcccttcctcagctctcatcactcagacttggtaatccctgggctacacgactgactctctcccagctgctctgggagtctcagggccaagcctgtatctcttcactctgcagaggccgcccaggtgctgggaatggcacggagcagagactcaggaacacttgatgaataaatgagtgatcagctttctaa

SEQ ID NO: 140679 - DNA, 2575 bp, Homo sapiens
  Payload ID: 7590
  Gene Symbol: HHIPL2
  Gene Name: HHIP-like 2
  Uniprot ID: Q6UWX4
  ENST ID: ENST00000343410
  CDS Start-End: 60-2234
ggcagagcagggaagccaacctgagcaaacacagcagcccgagtgttcccaaggccaaaatgctgagaacgtccactcctaatctgtgtggtggtctgcattgccgggccccctggctctcttctggcattctctgcctctgcctcatattcttgttgggccaggtgggcttgctgcagggacacccccagtgcctggattacgggccccctttccagccccctctgcaccttgagttttgctctgactatgagtccttcggctgctgtgatcagcacaaggaccgccgcatcgctgcccggtactgggacatcatggaatattttgatctgaagagacatgagctgtgtggagattacattaaagacatcctttgccaggagtgctcgccctacgcagcccacctctacgacgccgaaaacacccagacgcctctccggaatctcccgggcctctgctctgattactgctctgccttccattctaactgtcactcagccatttccctgctgaccaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaacccttcctggacctcaagaacatcgtgttgaccaccccatggatcggggatgagagaggcttcttggggttggcttttcaccccaaattccgccacaatcgcaagttctatatttattattcgtgcctggacaagaagaaggtagaaaagatccgaattagtgagatgaaggtttctcgggctgatcctaacaaagctgacctgaaatcagagagggtcatcttggagattgaagaaccagcctcaaaccataatggcggacaacttctttttggcctggatggctatatgtacatattcactggggacgggggacaggctggagatccctttggcctgtttggaaatgctcagaacaaaagttccctgctgggaaaagttttaaggatcgatgtgaacagggcaggctcacatggcaagcggtaccgagtcccctcggacaatccatttgtttctgagccaggggcccaccccgccatctatgcctatgggatcaggaacatgtggcgttgtgctgtggaccgaggggaccccatcacgcgccagggccgaggccggatattctgtggggacgtgggccagaacaggtttgaagaggttgacctcattttgaaaggtggaaactatggctggagagcaaaggaagggtttgcatgttatgacaaaaaactttgtcacaatgcctctttggatgatgttctgccaatctatgcttatggccatgcagtggggaagtcagtcactggaggttatgtctatcgtggttgtgaatccccaaatctcaatggcctgtatatctttggagacttcatgagtggtcgacttatggctttgcaggaagatagaaaaaacaagaaatggaagaagcaggatctttgcctgggcagcaccacgtcctgtgccttcccagggctgatcagcacccatagcaagttcatcatctcctttgctgaagatgaagcaggggagctgtatttcctggcgacctcttacccaagtgcctatgcaccacgtggatctatttacaagtttgttgacccctcaaggcgagcacccccaggcaagtgcaaatacaagccagtgcccgtgagaaccaagagtaagcggatcccgttcagaccactcgccaagacagtcttggacttgctaaaggaacaatcagagaaagctgctagaaaatcttccagtgcaaccttagcttctggcccagcccagggtttgtctgagaaaggctcctccaagaagctggcttctcctacaagcagcaagaatacattgcgagggcctggtacaaagaagaaagccagagtggggccccacgtccgccagggcaagaggaggaagagcctgaaaagccacagtggcaggatgaggccatcagcagagcagaagcgagctggcagaagtctcccttgacctattggtcaaggtggccgacagggtgacgtgagagaggagagccacctcatcaaatgaaagtcactgctgaataaagaccttagaagtctgggaagccagggtagaggtggggcagggcggttttcctctccctgggaaatcttgctgtctactgaataaataaatgcaccttctctgtatgcagtgcttctgtgggagaccatatcccagattgctggtgcacctgggttatggtaagcactagtccatgagcctgcttggaatcacactggatgtctccgttttgtcttgtaaatgcctacaacctgaggtaataaatcaacatttgctcaaactgg

SEQ ID NO: 140680 - DNA, 762 bp, Homo sapiens
  Payload ID: 7591
  Gene Symbol: HID1
  Gene Name: HID1 domain containing
  ENST ID: ENST00000318565
  CDS Start-End: 1-748
cgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacggtaggggcccggagcttgcactccccgcgctcaccaccaggtggtgtcaggccacaggccaacctgccacttgctccaggtttcaagcccctccagcccacagaaagaacgcaagcttgtgtacccttcatagtagccacattaaaaaaaaagggtgacaacaattgaataa

SEQ ID NO: 140681 - DNA, 3271 bp, Homo sapiens
  Payload ID: 7591
  Gene Symbol: HID1
  Gene Name: HID1 domain containing
  Uniprot ID: Q8IV36
  ENST ID: ENST00000425042
  CDS Start-End: 79-2445
gcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgactgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccatggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctcca

SEQ ID NO: 140682 - DNA, 820 bp, Homo sapiens
  Payload ID: 7591
  Gene Symbol: HID1
  Gene Name: HID1 domain containing
  ENST ID: ENST00000530857
  CDS Start-End: 61-820
ctgaagccggagccgggttggagtctgggcgggggccgggccggagcgggctccagagacatggggtcgaccgactccaagctgaacttccggaaggcggtgatccagctcaccaccaagacgcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactcca

SEQ ID NO: 140683 - DNA, 2514 bp, Homo sapiens
  Payload ID: 7591
  Gene Symbol: HID1
  Gene Name: HID1 domain containing
  ENST ID: ENST00000534480
  CDS Start-End: 65-640
ggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctgcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgactgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggca

SEQ ID NO: 140684 - DNA, 458 bp, Homo sapiens
  Payload ID: 7591
  Gene Symbol: HID1
  Gene Name: HID1 domain containing
  ENST ID: ENST00000581676
  CDS Start-End: 116-458
ggcgcgccgcttgtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggggagaagaggatgatgagcatgccaggcccctggccgagtccctgctcctggccattgctgacctgctcttctgcccggacttcacggttcagagccaccggagga

SEQ ID NO: 140685 - DNA, 1373 bp, Homo sapiens
  Payload ID: 7592
  Gene Symbol: HIGD1A
  Gene Name: HIG1 hypoxia inducible domain family, member 1A
  Uniprot ID: Q9Y241
  ENST ID: ENST00000321331
  CDS Start-End: 119-400
ggctgggacggctgtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatgtattgttattaaagtaagtgacccatgtcaaa

SEQ ID NO: 140686 - DNA, 585 bp, Homo sapiens
  Payload ID: 7592
  Gene Symbol: HIGD1A
  Gene Name: HIG1 hypoxia inducible domain family, member 1A
  Uniprot ID: Q9Y241
  ENST ID: ENST00000452906
  CDS Start-End: 243-566
aagcgaaacaagccgggggactgcgagccagggactcgggccgcggggcgggaagaagtggggcagcgcttggccaggccgaaaggactttgggggtgggggctgggagtccgtgtctcgaatgagggaggagaggtggagttgccggggctcaggcccggcctcgagcatgggcggatgagaggagtcgggagccgaggcctagggtccttcgggtgaggggagacggagccagcgaggagatggagcagaagcttgtggaggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttg

SEQ ID NO: 140687 - DNA, 1322 bp, Homo sapiens
  Payload ID: 7592
  Gene Symbol: HIGD1A
  Gene Name: HIG1 hypoxia inducible domain family, member 1A
  Uniprot ID: Q9Y241
  ENST ID: ENST00000418900
  CDS Start-End: 100-381
gcgcctgcagggatcggaagccggttggggtgtgagaggttttctcgctctagaacctcatagaaattctttctcagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataatttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgttaacatggtatatg

SEQ ID NO: 140688 - DNA, 741 bp, Homo sapiens
  Payload ID: 7592
  Gene Symbol: HIGD1A
  Gene Name: HIG1 hypoxia inducible domain family, member 1A
  ENST ID: ENST00000430190
  CDS Start-End: 78-368
gtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttgcattctttttctttaggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatg

SEQ ID NO: 140689 - DNA, 635 bp, Homo sapiens
  Payload ID: 7593
  Gene Symbol: HIGD1B
  Gene Name: HIG1 hypoxia inducible domain family, member 1B
  Uniprot ID: Q9P298
  ENST ID: ENST00000253410
  CDS Start-End: 252-551
ggggaagaggcagatggtaggaaatggagacggagaaatggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgacgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaatcaa

SEQ ID NO: 140690 - DNA, 457 bp, Homo sapiens
  Payload ID: 7593
  Gene Symbol: HIGD1B
  Gene Name: HIG1 hypoxia inducible domain family, member 1B
  ENST ID: ENST00000587021
  CDS Start-End: 213-377
ggcactaatggcccagccacctgagatgggatacctgggagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattatgtctgctaacagacgctggtgggtaccacctgacgacgaagactgtgtgtctgagaagctcctgaggaagactcgggaatctccactggtgcctataggtgctgtgtacacaatgtacagcgattacgtcaagaggatggcacaggatgctggagagaagtaggactcctataggagccggggctgtccaactcccctaactcaatccctggtacattcctaataaagcagttttgaggaaaa

SEQ ID NO: 140691 - DNA, 470 bp, Homo sapiens
  Payload ID: 7593
  Gene Symbol: HIGD1B
  Gene Name: HIG1 hypoxia inducible domain family, member 1B
  ENST ID: ENST00000586911
  CDS Start-End: 1-122
agctcctgaggaagactcgggaatctccactggtgcctataggtcccccgcaacgcccaccccccgccaccagatgctgcataaaaccagctgtttatccagatgcccagcctgcctggtaaggtatctctcatcaggggagtgctgtgcattgtggctgtggcccaggggctgtgttctctgcccacaggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaa

SEQ ID NO: 140692 - DNA, 547 bp, Homo sapiens
  Payload ID: 7593
  Gene Symbol: HIGD1B
  Gene Name: HIG1 hypoxia inducible domain family, member 1B
  Uniprot ID: Q9P298
  ENST ID: ENST00000591513
  CDS Start-End: 168-467
ttggtcggttcaaaacagcagacgctgagccctggcctggccgcccgttctcctcgttctagccatctcttaggactgaggaatcagagttctgattgtggagtgcctctctctaggacggggctgcagcataggagtctcagctgcttacatccaggtccaggattatgtctgctaacagacgctggtgggtaccacctgacgacgaagactgtgtgtctgagaagctcctgaggaagactcgggaatctccactggtgcctataggcttaggaggctgcttggtggtagcagcatacaggatttaccggctgaggtctcgtggttccaccaagatgtccatacacctgattcacacccgagtggcagcgcaggcctgtgcagtgggtgcaatcatgctaggtgctgtgtacacaatgtacagcgattacgtcaagaggatggcacaggatgctggagagaagtaggactcctataggagccggggctgtccaactcccctaactcaatccctggtacattcctaataaagcagttttgaggaaaa

SEQ ID NO: 140693 - DNA, 371 bp, Homo sapiens
  Payload ID: 7594
  Gene Symbol: HIGD1C
  Gene Name: HIG1 hypoxia inducible domain family, member 1C
  Uniprot ID: A8MV81
  ENST ID: ENST00000398455
  CDS Start-End: 78-371
gatgggagaggaaaaacaaattatttttaatgattcacggcaaccacatttatatcctattgttactagagaaaaaaatgtcttcagataaccagtggtcagcagatgaggatgaaggccaattatcccgactaatcaggaaatctagagactccccctttgtccctataggtatagcaggctttgtgactgtggtgtcctgtggtctttacaagctaaagtacagaagagatcagaaaatgtcaattcatcttattcacatgagagttgctgcccaaggatttgttgttggagctgtgactctaggtgttctctattctatgtataaggattacattagaccacgattcttcagtgagtccaaaaaatga

SEQ ID NO: 140694 - DNA, 668 bp, Homo sapiens
  Payload ID: 7595
  Gene Symbol: HIGD2A
  Gene Name: HIG1 hypoxia inducible domain family, member 2A
  Uniprot ID: Q9BW72
  ENST ID: ENST00000274787
  CDS Start-End: 74-394
ccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtatttaattcagtatca

SEQ ID NO: 140695 - DNA, 1116 bp, Homo sapiens
  Payload ID: 7596
  Gene Symbol: HIGD2B
  Gene Name: HIG1 hypoxia inducible domain family, member 2B
  Uniprot ID: Q4VC39
  ENST ID: ENST00000311755
  CDS Start-End: 525-845
ggaggactgtgaggaagcgggggaaggaagtaaatcgccgagtgacctaaggaatcagggggaggattagggtctgctccacagaaggcttacctctgaaagagtcggggagggaatgcgcagccactcgctgcctttatcccgagaagcccctaacacccctcgccgtggtctgtacatggtctgtacctccggccgcgctggctggtaggccagccacctgggatggcagcctagttctcccgccaccttaccctgccctgactctaatctgcatttaattcagtccttcttccgggagatttcggcggagaatttctttctcgccttagctactgaggtcaaacctgaaataggctgtagactccaccagctgggtaagaatgggaagaagatcagaaaacctaaactttggttgatggactattttgcccaggcaaaagcagggaatctatgaggaatatgaagacattcgtcgggagaactctgttggcactttccactgttccatctgtggcctaggcatggcgactctcggctttgtgactccggaggccccctttgaatcatcgaagccccccatctttgaggggcttagccccactgtttacagcaatccagagggtttcaaggaaaagttccttcgcaagacccgcgagaatccggtggtacccataggtttcctgtgcacggcggccgtcctcaccaacggcctctactgcttccaccagggcaacagccaatgttcacggcttatgatgcacacccagatcgccgcccagggcttcaccattgcagccatcttgctgggtctagctgccaccgctatgaagtctccaccctgagcccagggtcttgaaaactctgcagaaatcattccaaaacccaggagcaaccactggccctaccatgggacttactctctcctctcctttgagaggtccctgtgtcgttgggggaggaagtgacccttcctgtaaccataactgaaagattttttcaaaaatcccagattctgttgtttgaatgttacatatttctatttgtgccacatcttccctccactcccctgcttaataaactctaaaaataagaaaaaagtaaaaaattacacac

SEQ ID NO: 140696 - DNA, 4571 bp, Homo sapiens
  Payload ID: 7597
  Gene Symbol: HDLBP
  Gene Name: high density lipoprotein binding protein
  ENST ID: ENST00000310931
  CDS Start-End: 376-4182
tttgccaactgcttcctggctcagtgcgacctggccttcttcccctcccccatgcggccggcttccgagtgcgcaagcccagagtcgtccgcgttgtccgcctctgcgcaagcgccgtgctcctcccacggcagttggccatatagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaa

SEQ ID NO: 140697 - DNA, 3297 bp, Homo sapiens
  Payload ID: 7597
  Gene Symbol: HDLBP
  Gene Name: high density lipoprotein binding protein
  ENST ID: ENST00000373292
  CDS Start-End: 1-2920
aggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgacttt

SEQ ID NO: 140698 - DNA, 6372 bp, Homo sapiens
  Payload ID: 7597
  Gene Symbol: HDLBP
  Gene Name: high density lipoprotein binding protein
  ENST ID: ENST00000391975
  CDS Start-End: 229-4035
aggcgggattgggccgccgccctatatagcagccggggcccgggcgccgcgcctcggagcgtcccggcttctcccgcgcggggggcgagtaagccagcggcaggaccagcgggcgggggcccacgacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgtca

SEQ ID NO: 140699 - DNA, 4489 bp, Homo sapiens
  Payload ID: 7597
  Gene Symbol: HDLBP
  Gene Name: high density lipoprotein binding protein
  ENST ID: ENST00000391976
  CDS Start-End: 294-4100
gatcggggggcctctctgggattggctgcgcgcacgtcacgtggggccgacgggccctgcgcagaccatcgagtcgggcgtccctccccggggacgtggccttcctgtgcccgggctggggcccgccgccccgcgggggagggcggagctggcgcggcccctagctttctccttctggtgtggggcccgagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaa

SEQ ID NO: 140700 - DNA, 996 bp, Homo sapiens
  Payload ID: 7597
  Gene Symbol: HDLBP
  Gene Name: high density lipoprotein binding protein
  ENST ID: ENST00000452065
  CDS Start-End: 505-996
gcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgcttt

SEQ ID NO: 140701 - DNA, 801 bp, Homo sapiens
  Payload ID: 7597
  Gene Symbol: HDLBP
  Gene Name: high density lipoprotein binding protein
  ENST ID: ENST00000452931
  CDS Start-End: 1-801
catacatgcttatgccaagctgtgagcacccttgcttctgaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactgga

SEQ ID NO: 140702 - DNA, 581 bp, Homo sapiens
  Payload ID: 7597
  Gene Symbol: HDLBP
  Gene Name: high density lipoprotein binding protein
  ENST ID: ENST00000413241
  CDS Start-End: 337-581
aagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgt

SEQ ID NO: 140703 - DNA, 530 bp, Homo sapiens
  Payload ID: 7597
  Gene Symbol: HDLBP
  Gene Name: high density lipoprotein binding protein
  ENST ID: ENST00000425989
  CDS Start-End: 294-530
gattcaaaaagtatttgagaacctactaggtgctagacaccaaccgaggcaatgagtatgggtgacaacatgtgccctgccctcacagcaccaatagtccactggacaaataccatctggaacatcaggtaaacacctaagcctgtctggaggaaatctaatttgggcggaatcccacaagcacagactagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtg

SEQ ID NO: 140704 - DNA, 525 bp, Homo sapiens
  Payload ID: 7597
  Gene Symbol: HDLBP
  Gene Name: high density lipoprotein binding protein
  ENST ID: ENST00000417540
  CDS Start-End: 483-525
atatagaggctgggggtggggggggaggtcaagcgtagcctcttctcctttaccaagatggcggcttgtccctgtttcgccacagttcctaccttatgagctcggttttcttatgcttataagagtggaacagacacatgcctcactcctgtcagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaac

SEQ ID NO: 140705 - DNA, 997 bp, Homo sapiens
  Payload ID: 7597
  Gene Symbol: HDLBP
  Gene Name: high density lipoprotein binding protein
  ENST ID: ENST00000453141
  CDS Start-End: 1-997
aagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcgg

SEQ ID NO: 140706 - DNA, 594 bp, Homo sapiens
  Payload ID: 7597
  Gene Symbol: HDLBP
  Gene Name: high density lipoprotein binding protein
  ENST ID: ENST00000426343
  CDS Start-End: 305-594
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggaga

SEQ ID NO: 140707 - DNA, 529 bp, Homo sapiens
  Payload ID: 7597
  Gene Symbol: HDLBP
  Gene Name: high density lipoprotein binding protein
  ENST ID: ENST00000449864
  CDS Start-End: 421-529
atatagcagccggggcccgggcgccgcgcctcggagcgtcccggcttctcccgcgcggggggcgagtaagccagcggcaggaccagcgggcgggggcccacgacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaaggggcgactggccaggcatgaggaaatgaatcaagtacagtgagatttaacatgtgggcagctttctggaaagccagcgaatttgaccattgttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactca

SEQ ID NO: 140708 - DNA, 566 bp, Homo sapiens
  Payload ID: 7597
  Gene Symbol: HDLBP
  Gene Name: high density lipoprotein binding protein
  ENST ID: ENST00000449504
  CDS Start-End: 515-566
ctcggagcgtcccggcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtg

SEQ ID NO: 140709 - DNA, 708 bp, Homo sapiens
  Payload ID: 7597
  Gene Symbol: HDLBP
  Gene Name: high density lipoprotein binding protein
  ENST ID: ENST00000441124
  CDS Start-End: 330-708
ggggacgtggccttcctgtgcccgggctggggcccgccgccccgcgggggagggcggagctggcgcggcccctagctttctccttctggtgtggggcccgaggtcagagcccagcacaacaacccttcttctggttcagccgcccagcggttatgtggggtacgggaaagatgatccagccatgcaggagagcaccagtggttctgtgaggattttacttcaaaatacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctcca

SEQ ID NO: 140710 - DNA, 459 bp, Homo sapiens
  Payload ID: 7597
  Gene Symbol: HDLBP
  Gene Name: high density lipoprotein binding protein
  ENST ID: ENST00000427007
  CDS Start-End: 402-459
cgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctgg

SEQ ID NO: 140711 - DNA, 6238 bp, Homo sapiens
  Payload ID: 7597
  Gene Symbol: HDLBP
  Gene Name: high density lipoprotein binding protein
  Uniprot ID: Q00341
  ENST ID: ENST00000427183
  CDS Start-End: 197-3904
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttg

SEQ ID NO: 140712 - DNA, 559 bp, Homo sapiens
  Payload ID: 7597
  Gene Symbol: HDLBP
  Gene Name: high density lipoprotein binding protein
  ENST ID: ENST00000420451
  CDS Start-End: 353-559
atatagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcatttttggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccga

SEQ ID NO: 140713 - DNA, 929 bp, Homo sapiens
  Payload ID: 7597
  Gene Symbol: HDLBP
  Gene Name: high density lipoprotein binding protein
  ENST ID: ENST00000422933
  CDS Start-End: 256-929
agaaacttgcctgagtattggtgttagtaaccaaagcataaatatcttgaccttttctgattttgaggtaaaaagatctgagttgtaaaatgtagataagtaacttttctctggtttcctctctctcctctcccacttcccatcccataccagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtgga

SEQ ID NO: 140714 - DNA, 612 bp, Homo sapiens
  Payload ID: 7597
  Gene Symbol: HDLBP
  Gene Name: high density lipoprotein binding protein
  ENST ID: ENST00000430918
  CDS Start-End: 188-612
acaacagacagccttaggggaaatggggaaactggagaaaagggctcttatcccaaaaggaccagatccattggaacagatagagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaagga

SEQ ID NO: 140715 - DNA, 1096 bp, Homo sapiens
  Payload ID: 7597
  Gene Symbol: HDLBP
  Gene Name: high density lipoprotein binding protein
  ENST ID: ENST00000428482
  CDS Start-End: 434-1096
gtcaagcgtagcctcttctcctttaccaagatggcggcttgtccctgtttcgccacagttcctaccttatgagctcggttttcttatgcttataagagtggaacagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaa

SEQ ID NO: 140716 - DNA, 924 bp, Homo sapiens
  Payload ID: 7597
  Gene Symbol: HDLBP
  Gene Name: high density lipoprotein binding protein
  ENST ID: ENST00000427487
  CDS Start-End: 1-924
ccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaaggcacgtggtgtcaggctaacacagtgggattggtttctgcagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaa

SEQ ID NO: 140717 - DNA, 420 bp, Homo sapiens
  Payload ID: 7597
  Gene Symbol: HDLBP
  Gene Name: high density lipoprotein binding protein
  ENST ID: ENST00000458564
  CDS Start-End: 281-420
ccgcgcggggggcgagtaagccagcggcaggaccagcgggcgggggcccacgagtcagagcccagcacaacaacccttcttctggttcagccgcccagcggttatgtggggtacgggaaagatgatccagccatgcaggagagcaccagtggttctgtgaggattttacttcaaaatacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccact

SEQ ID NO: 140718 - DNA, 578 bp, Homo sapiens
  Payload ID: 7597
  Gene Symbol: HDLBP
  Gene Name: high density lipoprotein binding protein
  ENST ID: ENST00000422080
  CDS Start-End: 418-578
tcggagcgtcccggcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcct

SEQ ID NO: 140719 - DNA, 683 bp, Homo sapiens
  Payload ID: 7597
  Gene Symbol: HDLBP
  Gene Name: high density lipoprotein binding protein
  ENST ID: ENST00000442730
  CDS Start-End: 1-381
cgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggtcagatgcgggcttctgccctcctgggtcccagggagggtgggcgggcaggcgggcttggtgtcctgagggtggcaactgcgtcggaagctgcttgcgagttggggagcatcccctcctgaagccgtgtcctctctctgcacaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcc

SEQ ID NO: 140720 - DNA, 544 bp, Homo sapiens
  Payload ID: 7597
  Gene Symbol: HDLBP
  Gene Name: high density lipoprotein binding protein
  ENST ID: ENST00000423693
  CDS Start-End: 301-544
aagcgtagcctcttctcctttaccaagatggcggcttgtccctgtttcgccacagttcctaccttatgagctcggttttcttatgcttataagagtggaacagacacatgcctcactcctgtcagcagttccaccttttcatggttgaggagcacatgtggtcgccagcctcccatctccagagtcccctaaggcaagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatg

SEQ ID NO: 140721 - DNA, 569 bp, Homo sapiens
  Payload ID: 7597
  Gene Symbol: HDLBP
  Gene Name: high density lipoprotein binding protein
  ENST ID: ENST00000442714
  CDS Start-End: 185-569
agccgtccttcctgctccctttctggtcttcggttgtttccactcgggttcttgcggggcgcgctccctctgctttctggagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggcctcagcaactgttgccattcccaaagaacaccatcgctttgttattggcaaaaatggagagaaactgcaagacttggagctaaaaactgca

SEQ ID NO: 140722 - DNA, 598 bp, Homo sapiens
  Payload ID: 7597
  Gene Symbol: HDLBP
  Gene Name: high density lipoprotein binding protein
  ENST ID: ENST00000444092
  CDS Start-End: 158-598
ggtggcatctgcgaaagttcctccatgcaggatgggtgccgacttccagaacttgcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactg

SEQ ID NO: 140723 - DNA, 4046 bp, Homo sapiens
  Payload ID: 7598
  Gene Symbol: HMG20A
  Gene Name: high mobility group 20A
  Uniprot ID: Q9NP66
  ENST ID: ENST00000336216
  CDS Start-End: 359-1402
aaacctccacgaaaataaggctcaccttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattca

SEQ ID NO: 140724 - DNA, 4112 bp, Homo sapiens
  Payload ID: 7598
  Gene Symbol: HMG20A
  Gene Name: high mobility group 20A
  Uniprot ID: Q9NP66
  ENST ID: ENST00000381714
  CDS Start-End: 429-1472
accttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaa

SEQ ID NO: 140725 - DNA, 479 bp, Homo sapiens
  Payload ID: 7598
  Gene Symbol: HMG20A
  Gene Name: high mobility group 20A
  ENST ID: ENST00000558176
  CDS Start-End: 402-479
gattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggtaagcagctgctttaggacactggacttctccataggcctcaaaacaaagcttctagcaaagttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggatatgttcggttcatgaatgagcgtcgagaacaacttcgagcaaagagaccagaagtcccatttccagaaatcacaaggatgttaggcaat

SEQ ID NO: 140726 - DNA, 644 bp, Homo sapiens
  Payload ID: 7598
  Gene Symbol: HMG20A
  Gene Name: high mobility group 20A
  ENST ID: ENST00000558845
  CDS Start-End: 1-355
agctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcctgttgcatggttgttaaatgtagtaaataatattagaaaagagaatcactgtagtcccagctacttgggaggctgaggtgggaggattgcttgagcccagcagttcaagtccagagagatcctgtctctaaaaataaaagaaaacagactcaa

SEQ ID NO: 140727 - DNA, 559 bp, Homo sapiens
  Payload ID: 7598
  Gene Symbol: HMG20A
  Gene Name: high mobility group 20A
  ENST ID: ENST00000560867
  CDS Start-End: 73-559
aaggttaaaaggcccatttaccatacagtttaaattgatgtgtccaagtcaagaaaataaatatttagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgtt

SEQ ID NO: 140728 - DNA, 631 bp, Homo sapiens
  Payload ID: 7598
  Gene Symbol: HMG20A
  Gene Name: high mobility group 20A
  ENST ID: ENST00000560498
  CDS Start-End: 331-631
gacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaataaaaaaaaaaaaactacatctcccagaaacctccacgaaaataaggctcaccttgcgtaaccacgtagtccttcgccgcattggggcaaaataatcccttcatttttgtgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagca

SEQ ID NO: 140729 - DNA, 563 bp, Homo sapiens
  Payload ID: 7598
  Gene Symbol: HMG20A
  Gene Name: high mobility group 20A
  ENST ID: ENST00000559035
  CDS Start-End: 108-362
gagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtagga

SEQ ID NO: 140730 - DNA, 494 bp, Homo sapiens
  Payload ID: 7598
  Gene Symbol: HMG20A
  Gene Name: high mobility group 20A
  ENST ID: ENST00000558651
  CDS Start-End: 407-494
cttcatttttgtgaaggtaccgtggaaaatatttcatttttcttctcaccggagcaattgtaaatgctatgcggtaagaggagttacctgtggaaaggtggttaagagattagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagta

SEQ ID NO: 140731 - DNA, 558 bp, Homo sapiens
  Payload ID: 7598
  Gene Symbol: HMG20A
  Gene Name: high mobility group 20A
  ENST ID: ENST00000559099
  CDS Start-End: 89-558
aagcaaggcgagcttgggggtggccccagtcgagatgcccttcaccccttgaagatcacccctcttttggtggtggtggtactgagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcaga

SEQ ID NO: 140732 - DNA, 886 bp, Homo sapiens
  Payload ID: 7599
  Gene Symbol: HMG20B
  Gene Name: high mobility group 20B
  ENST ID: ENST00000262949
  CDS Start-End: 28-886
tctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagcccggttctgcagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcaggcttcccctgcttcaagccttctggtgctgccccccagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgg

SEQ ID NO: 140733 - DNA, 1596 bp, Homo sapiens
  Payload ID: 7599
  Gene Symbol: HMG20B
  Gene Name: high mobility group 20B
  Uniprot ID: Q9P0W2
  ENST ID: ENST00000333651
  CDS Start-End: 76-1029
gcgggcggttggttggagcgtcgcgcagtcgggaggtccgggaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaagcttg

SEQ ID NO: 140734 - DNA, 616 bp, Homo sapiens
  Payload ID: 7599
  Gene Symbol: HMG20B
  Gene Name: high mobility group 20B
  ENST ID: ENST00000435022
  CDS Start-End: 35-412
gaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagcccggttctgcagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactga

SEQ ID NO: 140735 - DNA, 561 bp, Homo sapiens
  Payload ID: 7599
  Gene Symbol: HMG20B
  Gene Name: high mobility group 20B
  ENST ID: ENST00000417382
  CDS Start-End: 66-561
ggttggagcgtcgcgcagtcgggaggtccgggaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagtacgccaggcccccctcccaacgacgcagcccggttctgcagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccagg

SEQ ID NO: 140736 - DNA, 759 bp, Homo sapiens
  Payload ID: 7599
  Gene Symbol: HMG20B
  Gene Name: high mobility group 20B
  ENST ID: ENST00000453933
  CDS Start-End: 334-759
gggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcc

SEQ ID NO: 140737 - DNA, 711 bp, Homo sapiens
  Payload ID: 7599
  Gene Symbol: HMG20B
  Gene Name: high mobility group 20B
  ENST ID: ENST00000416526
  CDS Start-End: 67-711
cgcgactcagcaacctccccaaccaatcgccggccggcgcgccgatcggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggag

SEQ ID NO: 140738 - DNA, 741 bp, Homo sapiens
  Payload ID: 7599
  Gene Symbol: HMG20B
  Gene Name: high mobility group 20B
  ENST ID: ENST00000585900
  CDS Start-End: 1-555
caaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaa

SEQ ID NO: 140739 - DNA, 1773 bp, Homo sapiens
  Payload ID: 7600
  Gene Symbol: HMGA1
  Gene Name: high mobility group AT-hook 1
  Uniprot ID: P17096
  ENST ID: ENST00000347617
  CDS Start-End: 136-426
ctttttaagctcccctgagccggtgctgcgctcctctaattgggactccgagccggggctatttctggcgctggcgcggctccaagaaggccatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 140740 - DNA, 1920 bp, Homo sapiens
  Payload ID: 7600
  Gene Symbol: HMGA1
  Gene Name: high mobility group AT-hook 1
  Uniprot ID: P17096
  ENST ID: ENST00000311487
  CDS Start-End: 250-573
ctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 140741 - DNA, 1848 bp, Homo sapiens
  Payload ID: 7600
  Gene Symbol: HMGA1
  Gene Name: high mobility group AT-hook 1
  Uniprot ID: P17096
  ENST ID: ENST00000374116
  CDS Start-End: 212-502
ggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 140742 - DNA, 1887 bp, Homo sapiens
  Payload ID: 7600
  Gene Symbol: HMGA1
  Gene Name: high mobility group AT-hook 1
  Uniprot ID: P17096
  ENST ID: ENST00000401473
  CDS Start-End: 250-540
ctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 140743 - DNA, 2159 bp, Homo sapiens
  Payload ID: 7600
  Gene Symbol: HMGA1
  Gene Name: high mobility group AT-hook 1
  Uniprot ID: P17096
  ENST ID: ENST00000447654
  CDS Start-End: 490-813
ctttttaagctcccctgagccggtgctgcgctcctctaattgggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 140744 - DNA, 1529 bp, Homo sapiens
  Payload ID: 7601
  Gene Symbol: HMGA2
  Gene Name: high mobility group AT-hook 2
  Uniprot ID: P52926
  ENST ID: ENST00000354636
  CDS Start-End: 812-1132
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggacaatctactaccaagaaccagctccaagaagaaaacatctctgggaaacagtaccaaaaggagtcactgaattgtcattggaggagtccaggatagctcttcatgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcgtacagggatccacctttttgcagaaatcacagtgtggctatggtgtggtttgatttcataaaacagatgcttaaaaagta

SEQ ID NO: 140745 - DNA, 611 bp, Homo sapiens
  Payload ID: 7601
  Gene Symbol: HMGA2
  Gene Name: high mobility group AT-hook 2
  ENST ID: ENST00000393577
  CDS Start-End: 149-505
agcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaa

SEQ ID NO: 140746 - DNA, 1993 bp, Homo sapiens
  Payload ID: 7601
  Gene Symbol: HMGA2
  Gene Name: high mobility group AT-hook 2
  Uniprot ID: P52926
  ENST ID: ENST00000393578
  CDS Start-End: 812-1084
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggaggagttttacattgcagcttagaagcctttcttccaatagcagagatttggtgtcatgtggtgttcatcagtttgaaaagaagtatttctgctgtttgcctcaagatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacctcatgtataaaatcctccatccagatgttgcttagtgatgcagctagtgcttctggaggaaaagaagcaagaaccaaataatgaagactacatcaatgggaacaagtgatacttttaggtgttttgttctcagaatattttaaaagaaaggaaattaacaacagaagaaaaatatttccctatatgaattaatggtttttataagaaaaatatctttctggagatactaagattgacctagaaattgatccaaggaccagatgcttaaagttcacttcaattggtcactagaaagatcccagcaatccccagctggtttctcaggctgctgattccctttatttggtaatggggtgtgtgcagtacgttgattaaaaaatatgcatttccattccattgcttttgaaggggggcagttgtctttctcttattaaagagcttgtgatacacaggaaagtgatgtaattttatatattagtcaaacgtgaggattttagataagacagcaagggtttttttcccctagtttgtagaaatctagaaatttaagtgatgatttgaggatcgagaagggagaactgaatcaaaataaaatctactacacaca

SEQ ID NO: 140747 - DNA, 4473 bp, Homo sapiens
  Payload ID: 7601
  Gene Symbol: HMGA2
  Gene Name: high mobility group AT-hook 2
  Uniprot ID: P52926
  ENST ID: ENST00000403681
  CDS Start-End: 1141-1470
cagcccgggatccccggcctgtccctttaaccccgccgccgggcgggagcacgtgagcggggctccgggtggcacccgggcgccgccgccgccgaggcagttgtatttcgaacgctgcctctggctagcagccaggcgccttggctcggcggtccgcctggcctccctcctcctcatacttttcttcctgcgcaaccccctcccctttatccgcccacgattagaggtgggcactccccccaccaccaccccctccccaagcgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatcaa

SEQ ID NO: 140748 - DNA, 1444 bp, Homo sapiens
  Payload ID: 7601
  Gene Symbol: HMGA2
  Gene Name: high mobility group AT-hook 2
  Uniprot ID: P52926
  ENST ID: ENST00000425208
  CDS Start-End: 812-1090
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccggtaggtcccggagtatgtttccatgctgcagaaggcatggagagattccaattgcgggggttcctccgtagcctttgcagctgaacgtctccatctcctgtccctgggcggtcagtcgctggcatggctctgtggagttttacctcccagttgtctatcaccaaagctgtccaccttgtccggaggggaatgagcgtggaaacccctggcggctgtactgacaaaagcaaccttag

SEQ ID NO: 140749 - DNA, 1788 bp, Homo sapiens
  Payload ID: 7601
  Gene Symbol: HMGA2
  Gene Name: high mobility group AT-hook 2
  ENST ID: ENST00000536545
  CDS Start-End: 812-1255
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggctggagtgcagtggtacaatctcggctcattgcaacctccacctcccaggttcaagcaattctcctgcctcaggctcctgagtagttgggattacaggcacccaccaccacacccagctaatttttgtatttttagtagagacagggtttcaccatgttggccaggctggtctcgaactcctgacctcaggtgagccacccaccttggcctctcaaagtgctgggaatacaggcgtgagccatcgtgcctggtctaaaaaatgtctattagtgttccatcactagatctcttctgaggtattcatgccatatgccccatcctgatgtcatatccacaggacaatctactaccaagaaccagctccaagaagaaaacatctctgggaaacagtaccaaaaggagtcactgaattgtcattggaggagtccaggatagctcttcatgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcg

SEQ ID NO: 140750 - DNA, 1508 bp, Homo sapiens
  Payload ID: 7601
  Gene Symbol: HMGA2
  Gene Name: high mobility group AT-hook 2
  Uniprot ID: P52926
  ENST ID: ENST00000537275
  CDS Start-End: 812-1123
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggttaagagctcaggctctggattcagatggcttgggttcaaattctggtccgtcacttagctaactggagtcttaagaaaatcacatgacctttaaaggtccagtttcctcatctgcaaaaggaggagttttacattgcagcttagaagcctttcttccaatagcagagatttggtgtcatgtggtgttcatcagtttgaaaagaagtatttctgctgtttgcctcaagatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacct

SEQ ID NO: 140751 - DNA, 8094 bp, Homo sapiens
  Payload ID: 7601
  Gene Symbol: HMGA2
  Gene Name: high mobility group AT-hook 2
  ENST ID: ENST00000541363
  CDS Start-End: 374-673
caacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggtaagacatagtcattaatttttttctcccaattaatataaaaagtgaaatatgtactgaaaaatgtccccaaactaaaccttatttcgcattttcttacttttggttatcgtcctgcagtattcctgaaaatgtgttgtagccttcaaagttaggaatatatagtctgcaatcgtaccatgaaaacctcccaaaatgtaaggtcttaagtgtacaaagcaaatataaattcttttaaaaataaaactattttattacattgcctcatatgtaaaacaaatatttaatcttatcctatattttaccaattcttaaacatcaaattttgtccttccaactgactgtctatattctgttgacaccagacttatatttaatgattcatgactggaaacatatttcttcattgaacaatttcataatatttgatgatcccaaaacactccaaagaatgctagaatacttggaaattaagttatactaacgtgcagactgatgcattcttagatcttatttaaataactgaatcacagtctctgaagtttttggcaacatcaaattggaaaatagctctacgtctcttgccccatattcctggagcaccttgtcctcactataatctgtacatagaaacattaaaaaaacatatttattgaggaagcatatcttgaagaaaacaaaactgaagtataaattaaccaggattgctaataatgtgagccagtattaaagtataagaacgtcctgctgttctcttcccttctgtatgtaaatagtcattggagatccaggtggtatcatgctgaacctgctaaaataagtagtaagcagtgtcatgagctatcaaattaagtagaactctttcatgtaattttaagtatccatgaaatttttttccctagaagtctttacaaatctaccttgcatcctgttttcttaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaatcattttcattgctgctcccatacctaaaagctaagagtgggagaggggtgctaaaaaaaacccagtgtttgtgcgtctttaagcaatatttaaaaatatatacatataaacaaaaacttgacattttcattaggagaacccaaatatatttagcctctcatcctttaactgtacaaaaatcaagagaaagtaaattgataattctgtgcatttgagtcaaaggatgaggcagagttcacatttgcatcacaggctgtgaactatagattaatcactttatgtggtttgttaatattgattcagcccttgtgcttagtgtcatagggaagatgagtcaaacaaagaaaaacagtcactgcatctgagaaatgtatttatatgtatatgcctgtgtcctatccagtggtatgctggaaccagcccttgtgagcaaatagtgaacatctcttctgaattctgtgttcagtgatgtcaagtaggtagcttgaaatccactatggtgggagtatttacaccatggaaagtgacaaatactacaaatcaggacttttttttttcctgaggagcaagtagttaaacatttacctccccagcatggccccacccttcagcgattctgtttatttggtctggagatccatcatattttttatgaactccctaagtgagtttaatatgcaactagagatgaagacactccatgaaaacacatgagaagatgtctgaacatttgttgagcaaatgaccacagaatgtcaatgtgtatgggacacacgggggatacagatgaatgagtggaatgcctcaggttatcaaggggatgataagactggaattttcttgttttgtttgattttgttgttgttgagttgcagaagggaaaactgaaacataaattaagggaaagaaattacagatgagatgaatggcatatagaaaggtagagaggcaagaacaaatacatcataggtggagattattaatatggctagaactgattgcaagttggacattaatacatcaagaaataatataagtgaaatcacagttgtttttcccaagagaattcagaatctcaaagaagccacaagtggattgagttgatcttcaaggatcaatctggctatcttacagaccctgttccagatttgccctttataggagagttcagactcagaattataaaaaagaacatgagctcattgggctacctaatttatattgtgtaatgacacagtgatgaattatataaacatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaaaagtgaaggaccaccctgttgcaggggtttgtgtttgcgaaatccaccaggtgtcatcagctgcaaacatcaagtgtgtcccataatcctaatgggagagttaatagtctcttaaaaatctaaaggggaaaatctgtaatatgtacgttaacttttttctaaaattccaaaaccaatgaaaacagcttacaaaataactctactatatttccacttcaagtgataaacaataaattgaaatcagctaattacaaataaatagaaatgaggctgggtgcagtggctcacacctgtaatcccaacactttgggaggtcaggagttcgagaccagcctggccaacatggtgaagccccatctctactaaatacacaaaaattagccgggcgtggcggcggccatctataatcccagctactcgggaggctgaggcaggagaatcacttgaacctggttggcgggggagggttgccgtgagcagagattgtgccactgcaccccagcctgggtgacagcgagactccatctcaaaagaaagaaagaaagaaatagaaagcagctcgttttttagcaatttgagcagttgaattctcagtcatatgaattacattcttcagtaggaaatggtggtaggtttttctttttctttttttaaaaaaagaaacaccataaaagtaccagattattattattattagagggtgctttgttactcaagtttttactttgataaaaataagtgtctctccaactgagatgtctaaaaaagtttcgctagtttatcaggtatttgatcgtttattgctatttcccttttaaggctttaatctgagacttgaagggactccctaaatgtaattcagacatttttctctcacctttcttctacccaaagggaaaacaggtttttaaaatcctaacagctctccaccctttcaatccactttccccattgttgtacagccctggcaaacgatgcctctggcaattaggacaggtataaacctgctccttttcaatttcccaatgagagaattgcaaagttttcagtttctaaaagactggaaacaaagctttctgtttcaaaaaaagagtttttacttgcaagtaacatcttctgtgggtggtgtgcacccgggcaaagaaatctcagtaagccttgattatcacgggatttcttccccctcaaaataaaatgttgaatgtttttacagagacttcaagggcagttttaaggatgtttatatttcagacaacctaaacattgtttggagcaaaatgagagatttcattttgggacaagcaagttgatgaattgcagtcagcatctcgttctcaaagaaggcatttttactgggggcttttagtctagacatacaaagagggaaggaggaaaggggaaagcattctcactctaacactcgtcttttacatggtaccttggccagtgcagtaaatagttcataataaatcagacttacaaatactcactcgtctactcactcaaggagcataatgatttatactgcctaagtcacaaagattaccgatgtatttattttcttgcttatgcactttcaagctagtaaaacatcttgtgggccagtaaatgtttagtaccaactggcaaaacatgaagaatcatatcaaaggttgccctaagttgcacggttttgttgtataggaaatactttttgacttaacctctgacctctgacatcaccaaggtcaagggaaaaggagagagcaaagtagaaaccaaggtttaacccttaataaagtagctcaaggacatagaagcacagggaaattggagggcagaggaagcgtatcaaaatgattattaactgtaaacagatgaagtaattagcttagctaacagttgtaatacaggaatattggcaggatgaagtcagcggttcttggcaggaaatgttttatagagatgacaacttctaacagaagtgaaagaacatcaatcaatttagggcaacttataaaactccaaaaagcaaaatttagtgtttctggacttgacaaatttgctgtgagagttttttttttaagtatgactgtttctgtgtggggaagtctgtggattaggctcaaaacaaaatggcagtggctgcctgcatttcctcttcatattgcagaattttcctctacattttgatgtgtactggataaaaaccaattgtttactcaatatataatctttcttcttactctccaaacttgctgacccaaattaatgtggaacaaatagcaactggctttaaaacctggtctttctaagaaaatccttaatggttgcatagaaatatgttgcattgcctcagacacttacattcaggaaatgtttgctggacactcagatgtctacagagaaattgttaacttactgttattgatatttttataatcttactcaaaagtcataactcaggataatgaaaaatgtttggtgcaataatgattaaaatccacaaatattctgttccctggccgcaaatacaacacctatgcaaaattttacacatctacaaaacaaagggaaaaggtttttcctagtctatgccattaataagcacatctggaatataacccttaagcagtctttaatcataatttaaagctactttgcataaaaataagaacattccacaacagctgtggaaacattgaaataaattttcttcttctgggccgggcacggtggctcatgcctgttatcccagcactttgggaggcccaggcagaagtattccttgagcccaggagtttgagaccagcctgagcaacatagtgagaccccatctctatttaaaaaaaaaaaaaattaccttcttttgaatactttgtttatgcaaaaatccttttgctttctttagctatttttttaaatgcagtgttcctgcagtaagaattgaacctggcatggaaaactgatcaaaccggtagtcctcagaaatcatcactcctgaaacttgcaattagtttatacctaaaatgatttccctatttgaaaaatgtgcctaccatttccagattttaaaaaaatggccctttatcccagaaaggagaaattcattgtatcccagagaccagcattacttctgttgcagtattttcagtgatggaactctgttgaggctacagacaagaaaagcaggagagcattttaggaatctaagattttttattttactttcctctggggaccttctttaatagtttttttctttcttaagaacctatccttgaatcataggtaaagaaataatcacagaatgagtaactgacattaataatcacagcttcacactatagtcttactggatttttacgtttttcagggtttccccaagtggtggtcacatttcttacacaactctgcagtgtagatagacatgtatagtcattactgggctgacacggtgggactgagacctgctagtgccgtggttggcatctatgattagtgaggtccaagatcaaccttctttacattaaacatgccctagcaagaccttcaacccaactttattaagctgatgctaacgcacacaaagaagtcctaacaattctatgtttttatatacataatgcaaaaataaagacaagatcaggtacaattgctgtcaatatctcaacttattgtctccttttgaaaaacataattcccgcctagcatttccaccagaatcccttgctcttgccaggttatattgtttatatatgttccatttaacatgttttttaaaaatctgctgtagagttttcctagttggaggaaataatcactttccattaagttaaacagtcccgataaattttaaatgaaaatatctgacagagaaatagaaaaactcagccttgtggtcttgccggtcacttagctacagatggaacttgaaaaactggttcctggtcattgctgctgaagagagccctttatttctgttgtgacaggactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaag

SEQ ID NO: 140752 - DNA, 485 bp, Homo sapiens
  Payload ID: 7601
  Gene Symbol: HMGA2
  Gene Name: high mobility group AT-hook 2
  ENST ID: ENST00000539662
  CDS Start-End: 1-168
gaaccaaccggtgagccctctcctaagagacccaggggaagacccaaaggcagcaaaaacaagagtccctctaaagcagctcaaaagaaagcagaagccactggagaaaaacggccaagaggcagacctaggaaatggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccgccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtgggg

SEQ ID NO: 140753 - DNA, 1527 bp, Homo sapiens
  Payload ID: 7601
  Gene Symbol: HMGA2
  Gene Name: high mobility group AT-hook 2
  Uniprot ID: P52926
  ENST ID: ENST00000537429
  CDS Start-End: 812-1072
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggctacagaactaattactgtgaaaagacataaaggaatgagaagaccaaaaccgtatcctcatgatactgacaaatcagttggactgagcacacatgaatcaactgaagaacacttctgccaagttcaagttgtgtaaaagtggaggatatgagtcttgtggggacacagagttgaggcatgagctattagtcagagccgtaaggctgcctgcaggagaagaactttggatggagttttgaaggaagtgaggaaaagatctgaattaacgtattaacacataaagcttgtcatctgaacaggactataagcatctcgaggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccg

SEQ ID NO: 140754 - DNA, 2319 bp, Homo sapiens
  Payload ID: 7602
  Gene Symbol: HMGB1
  Gene Name: high mobility group box 1
  Uniprot ID: P09429
  ENST ID: ENST00000339872
  CDS Start-End: 165-812
atctcagggccaaaccgataggaaacgaggctgcctcgcggtggcaccgccaccccccaaccgggttccgagcaccggagctggctgctgctccctctttggagcaaagttttatgcaaagagggtgttttttgaaactttcggtgcacgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 140755 - DNA, 5485 bp, Homo sapiens
  Payload ID: 7602
  Gene Symbol: HMGB1
  Gene Name: high mobility group box 1
  Uniprot ID: P09429
  ENST ID: ENST00000341423
  CDS Start-End: 185-832
gccaataggagccgcgctggctggagagtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagataagaaaagcgcccatgtaacacaaactgccattcaacaggtatttcccttactacctaaggaattgtaaccattgctcagacattgtaggatttaactatgttgaaaactacaggagaggccgggcgcagtggctcacgcctgtaatcccagcactttgggaggccaaggcgggcagatcacgaggtcaggagattgagaccatcctggctaacgtggtgaaaccccgcctctactaaaaatacaaaaaattagccaagcgtggtgctgggcgcctgtagtcccagtaactcaggaggctgaggcaggagaatggcgtgaacccgggaggcggaggttgcagtgagccgagattgtgccactgcactccagcctgggtgacagagcaagactccatctcaaaaaaaaaaaaaaaacacaggagagacaactggtttttgaatgaaatacatgggtactgccttgcttgacatcacatagtccttgatgaaagttcacatttaggtctgcttggtacaatacgcctcctaaaaaggtccttgatgaaagttcacatttaggtctgcttggtacaacacgcctcctgaaagggtctgatagctttcagtagcagtaagacacttgcatgtgatggtaaggtatctgcaaatttgcacacaccgtacacagcttaagtcttagaattaacttgctaaaatgtgagcctttggtaattaggctgttttattagggagtgtgataatatttgaatttcttttcatatttgtgctttgtgtcattttcaaatgacccttgaaatgtattttaaaagtagataaaagccagaaagtgatttgattgtctatccagcaaaagatggtggttcattttcttgtcctcttaataccaaggcagtgctaataacacttgccacaacttgggaaattccatgggtctatgccacattgctcccagagtaatgaggcaaaatagtgctctgttatagaattgcttgtttcacgatacatcatgacagataaccatacaacatggaatgacacaaacataatatgccacactccagaatatgtaatgctcgtcttccaggggggttcagtctaaggtaatctctaccaggaagaaatgctagatgactttagacatgtgcattggtttggaccttctaattagtggaatttttacttattttgacatgagagattacatagaatctctatgttgcccaggttggtctccaaatctgctcaaacaatcctcccgcctcagtttctcaagtagctgggattacagggacacaccactgtgcttagcttaaatagttgaatttattgggcatccactgaaaagaaggaagtaggaataaaatctgcaatagtatgactaaacctgtaagtgagcatgagcagtggtgggcaagggtatgcagactctggaatccagaaatagaaagtcagtggaaagccaggcacagtggctcacacttataatcccagcactttgggaggccgaggtgggaggatcacttgaggccaggagtttgacactagcctgggcaacatagtgaggccttgtctactagaaataaataattttgcagatatactaaataccattttaaaaataagtggaaaagggattagagagatccttgtaaattatgtactcatattcattgttctctttagtcacataattcagtcatgtacgtgacattccacagtatggtgctccataatacatattttttcttttttcgatctcacttgtatatgatccataatatttttcatcattcccttactgatggacatttagattgtttcctattttttgctgtttaacagtactgcgctgaacatctgtacatttctctcaggcatgtgtgggtcttcagatacctcaaaagtagaactgctgagtcaaaagacatttgcatttaacattttggaagatgttgataaattgcaccccaccaccccccccccccgcccacaaaagctgttatttatgctgtgaaacattttaacaatgattttgcaattaa

SEQ ID NO: 140756 - DNA, 821 bp, Homo sapiens
  Payload ID: 7602
  Gene Symbol: HMGB1
  Gene Name: high mobility group box 1
  ENST ID: ENST00000326004
  CDS Start-End: 158-634
gtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgc

SEQ ID NO: 140757 - DNA, 1727 bp, Homo sapiens
  Payload ID: 7602
  Gene Symbol: HMGB1
  Gene Name: high mobility group box 1
  ENST ID: ENST00000399489
  CDS Start-End: 568-1044
ggttccgagcaccggagctggctgctgctccctctttggagcaaagttttatgcaaagagggtgttttttgaaactttcggtgcacggtgattttttttttttaaggtcccataattaggaagagtcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattcccttactaagtactttaaggtcttatatgtcataattttattgctaacatcaaatatttattttattttttagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttatta

SEQ ID NO: 140758 - DNA, 1282 bp, Homo sapiens
  Payload ID: 7602
  Gene Symbol: HMGB1
  Gene Name: high mobility group box 1
  Uniprot ID: P09429
  ENST ID: ENST00000399494
  CDS Start-End: 185-832
gcagtgcgggcccggccggcctcggcccggtcgcggcggcggcggcggccgggcggcggggggagcggcgccgctgcgctcgctggaacatggctgactcgggcccggcgctgctggctggagagaaaacaaggcgggcgggcgggggagctgggcgcagcagttccgagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaa

SEQ ID NO: 140759 - DNA, 4199 bp, Homo sapiens
  Payload ID: 7602
  Gene Symbol: HMGB1
  Gene Name: high mobility group box 1
  Uniprot ID: P09429
  ENST ID: ENST00000405805
  CDS Start-End: 942-1589
tttctgcggagggattacgctgacgaaagagacctgcttgcgcgtcgctgttccgtggtccgcgcgagcgtggtcgggagccgctggttcctggggtgacccgcggaggtgggagagggaagggcttccgaagccggcgggggtgccatggaccctctccgccggcgcggccttcacagctgggccgcgccgggcatccgtagtccgctctcccaaagcctcggtggagctgaagctgccacagagtgcatgttcacaaagggtcatcacacacggagctgcccctccctgtctccctagagcccatcttcgaggccaggggcttttctaccaggattctggggtgtttctcctcctttcctccctcccagatcttctcacggtaaggggagcagcgaaagcgcagggactttgcattccacgacccgttctgactagtcaacagccgatctgtccctgctgctctaattccagctgccctgccttgttttaacttcagagaaagggggagttctcatttgataagtttaagcctttgctttcgtaggaaggtcatgtggcttaagggacatcgtgaccgcgtatgctatttctgcctgtgcattctaaatcttgggggcagcatattccagaagtccttttggtcgattggttctgtgtcctaggataacaatttgtagtttctgaccatttctttacagaaaaaccacaattggtattttggactgcggggttttttagtggtctcaaactaaatgattatattctggaataatgctgacaatttggatagggtggtgtggaggaaacaagtctcgtgtagaagaaattatttagtaaaaaggattttagtttttggtacttctgaatgcaaatggccaaggaatccagcagtttgttggggtttctccagacaaaaataggctgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagat

SEQ ID NO: 140760 - DNA, 1889 bp, Homo sapiens
  Payload ID: 7603
  Gene Symbol: HMGB2
  Gene Name: high mobility group box 2
  Uniprot ID: P26583
  ENST ID: ENST00000296503
  CDS Start-End: 875-1504
cgggacgcgggaacggttccctcccggccccccgcgccctttccgaggttccctgccttgacttccccgagttctacgacaacctcagcgacagcgggaggagctgggcaatcggttttgcagggcaaactccaggctctcctcatttattattctctgggcggcgcacgggagaccctgcagggcaacagagcagagcgactacagctcccaggagccaacgctgcagggctgagccgacgcgggggacagacaggacctaaatggtggtcggaggaagggcaaggcagacctcttctgttaccttagcgccagcaaaccgagccgccgccgtcgccaagccaggagaccaacccccagtctcccgactaagtatttttaaatctggcggggctttccttcccgagccaaccactcccaccgtttacagccccaaccagtcagcgtgaggcccgccatttttcaaaccctcttcccgccgccaatcaggatcgagcagtacattcctctcctgaccggttctaacgggtctgggagttaacgacctgggcgacccaccgaacctgctaggctggggcgtggagggcgggtctggtaagacactgaccaatcgttagcctccgtggcaagggggcggggactatctgggtttgaataatcgtcagaaccaatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttcta

SEQ ID NO: 140761 - DNA, 1175 bp, Homo sapiens
  Payload ID: 7603
  Gene Symbol: HMGB2
  Gene Name: high mobility group box 2
  Uniprot ID: P26583
  ENST ID: ENST00000446922
  CDS Start-End: 167-796
gcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 140762 - DNA, 1032 bp, Homo sapiens
  Payload ID: 7603
  Gene Symbol: HMGB2
  Gene Name: high mobility group box 2
  Uniprot ID: P26583
  ENST ID: ENST00000438704
  CDS Start-End: 24-653
caggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 140763 - DNA, 629 bp, Homo sapiens
  Payload ID: 7603
  Gene Symbol: HMGB2
  Gene Name: high mobility group box 2
  ENST ID: ENST00000506267
  CDS Start-End: 227-629
tcgggttcgtggacctgcctttccccattccctcagagcctctactcggtctcggcgcagtggctctcggggtctgacccggcgagcggcatttggggtgcgggccggcgagggctgggtctgtggagggccggcgggcagtcggaggaggcggaaactgcccctgaccgggcccggttctgggagttttcaatgtcggtcacgaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctg

SEQ ID NO: 140764 - DNA, 3560 bp, Homo sapiens
  Payload ID: 7604
  Gene Symbol: HMGB3
  Gene Name: high mobility group box 3
  Uniprot ID: O15347
  ENST ID: ENST00000325307
  CDS Start-End: 97-699
aggcggctctcgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 140765 - DNA, 793 bp, Homo sapiens
  Payload ID: 7604
  Gene Symbol: HMGB3
  Gene Name: high mobility group box 3
  ENST ID: ENST00000455596
  CDS Start-End: 213-793
cgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggagga

SEQ ID NO: 140766 - DNA, 707 bp, Homo sapiens
  Payload ID: 7604
  Gene Symbol: HMGB3
  Gene Name: high mobility group box 3
  ENST ID: ENST00000419110
  CDS Start-End: 142-707
tttgtagttcagcttcaggccaagtgcttcagctccatataagaggtagctttcttgagagcagagatcgaaatatttcctatgcaaaggatggaaatacttcctgcgcgtaagcgcaatcctttcatcattcgaatcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggagga

SEQ ID NO: 140767 - DNA, 529 bp, Homo sapiens
  Payload ID: 7604
  Gene Symbol: HMGB3
  Gene Name: high mobility group box 3
  ENST ID: ENST00000430118
  CDS Start-End: 70-529
gtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatg

SEQ ID NO: 140768 - DNA, 812 bp, Homo sapiens
  Payload ID: 7604
  Gene Symbol: HMGB3
  Gene Name: high mobility group box 3
  Uniprot ID: O15347
  ENST ID: ENST00000448905
  CDS Start-End: 192-794
cgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtc

SEQ ID NO: 140769 - DNA, 2343 bp, Homo sapiens
  Payload ID: 7605
  Gene Symbol: HMGB4
  Gene Name: high mobility group box 4
  Uniprot ID: Q8WW32
  ENST ID: ENST00000519684
  CDS Start-End: 1744-2304
aagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctccgaggcggaagctccctctcagcttgtctggacagtgtttttcaaatccattcttggagtgtgacccatcagtgggtcatgagaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgta

SEQ ID NO: 140770 - DNA, 2505 bp, Homo sapiens
  Payload ID: 7605
  Gene Symbol: HMGB4
  Gene Name: high mobility group box 4
  Uniprot ID: Q8WW32
  ENST ID: ENST00000522796
  CDS Start-End: 1906-2466
ctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctccgaggcggaagctccctctcagcttgtctggacagtgtttttcaaatccattcttggagtgtgacccatcagtgggtcatgagactgcaatcaagatgtttgaaaatactgaactcacatctgtagacgaggagttggcagatttacgacccccagcttgcagcctattttttaaaaataaggttttattggaacatagccacactcattggtttagaaaggagctgtgtcccattcatctaggcagccctgctcatgtccaaaaaatgtaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgta

SEQ ID NO: 140771 - DNA, 1191 bp, Homo sapiens
  Payload ID: 7606
  Gene Symbol: HMGN2
  Gene Name: high mobility group nucleosomal binding domain 2
  Uniprot ID: P05204
  ENST ID: ENST00000361427
  CDS Start-End: 95-367
aagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaa

SEQ ID NO: 140772 - DNA, 1148 bp, Homo sapiens
  Payload ID: 7606
  Gene Symbol: HMGN2
  Gene Name: high mobility group nucleosomal binding domain 2
  Uniprot ID: P05204
  ENST ID: ENST00000619352
  CDS Start-End: 54-326
gaagaagaggcgagaacgacccccggaccgaccaaagcccgcgcgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttgg

SEQ ID NO: 140773 - DNA, 831 bp, Homo sapiens
  Payload ID: 7607
  Gene Symbol: HMGN3
  Gene Name: high mobility group nucleosomal binding domain 3
  Uniprot ID: Q15651
  ENST ID: ENST00000275036
  CDS Start-End: 130-363
gcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 140774 - DNA, 872 bp, Homo sapiens
  Payload ID: 7607
  Gene Symbol: HMGN3
  Gene Name: high mobility group nucleosomal binding domain 3
  Uniprot ID: Q15651
  ENST ID: ENST00000344726
  CDS Start-End: 130-429
gcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 140775 - DNA, 1010 bp, Homo sapiens
  Payload ID: 7607
  Gene Symbol: HMGN3
  Gene Name: high mobility group nucleosomal binding domain 3
  ENST ID: ENST00000620514
  CDS Start-End: 179-571
ggagcagcagggaggcgagcagagggcccccagagggagccgcggaggtgcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagagatccacatctctcgctcaactgttaatgtctcaacctccagaggcaccccacccagcacactgtcagtaaaggggcagattgaaacagtgagagcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgc

SEQ ID NO: 140776 - DNA, 1225 bp, Homo sapiens
  Payload ID: 7608
  Gene Symbol: HMGN4
  Gene Name: high mobility group nucleosomal binding domain 4
  Uniprot ID: O00479
  ENST ID: ENST00000377575
  CDS Start-End: 178-450
cttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggg

SEQ ID NO: 140777 - DNA, 1303 bp, Homo sapiens
  Payload ID: 7609
  Gene Symbol: HMGN1
  Gene Name: high mobility group nucleosome binding domain 1
  ENST ID: ENST00000288344
  CDS Start-End: 75-221
cgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 140778 - DNA, 709 bp, Homo sapiens
  Payload ID: 7609
  Gene Symbol: HMGN1
  Gene Name: high mobility group nucleosome binding domain 1
  ENST ID: ENST00000380747
  CDS Start-End: 126-476
gcttcacgcaggcctgcgaagctggagcccctggatagcctttcttgccgacagaggcgggagaaatttgctacttcctgtataccttatccttctcccttcccagtctaagatacgaactataaatgttcgaacccaattcaccccggaggggaggggccagataccagtggcctgaaggcgcccaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggata

SEQ ID NO: 140779 - DNA, 829 bp, Homo sapiens
  Payload ID: 7609
  Gene Symbol: HMGN1
  Gene Name: high mobility group nucleosome binding domain 1
  ENST ID: ENST00000380748
  CDS Start-End: 137-409
gcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaa

SEQ ID NO: 140780 - DNA, 1383 bp, Homo sapiens
  Payload ID: 7609
  Gene Symbol: HMGN1
  Gene Name: high mobility group nucleosome binding domain 1
  Uniprot ID: P05114
  ENST ID: ENST00000380749
  CDS Start-End: 284-586
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 140781 - DNA, 1552 bp, Homo sapiens
  Payload ID: 7609
  Gene Symbol: HMGN1
  Gene Name: high mobility group nucleosome binding domain 1
  ENST ID: ENST00000431390
  CDS Start-End: 224-361
cccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtagaagtttagcactgcagtcatcagaagaggcaagattaatttccttgacattgaggagttgttggataattactaaatttgtccttgttaaataaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 140782 - DNA, 823 bp, Homo sapiens
  Payload ID: 7609
  Gene Symbol: HMGN1
  Gene Name: high mobility group nucleosome binding domain 1
  ENST ID: ENST00000443046
  CDS Start-End: 138-272
agcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaagaaagttctgtttttgtgatccttttaaaaataaagcttcacggaagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagct

SEQ ID NO: 140783 - DNA, 850 bp, Homo sapiens
  Payload ID: 7609
  Gene Symbol: HMGN1
  Gene Name: high mobility group nucleosome binding domain 1
  ENST ID: ENST00000419378
  CDS Start-End: 124-261
cgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcata

SEQ ID NO: 140784 - DNA, 1045 bp, Homo sapiens
  Payload ID: 7609
  Gene Symbol: HMGN1
  Gene Name: high mobility group nucleosome binding domain 1
  ENST ID: ENST00000436324
  CDS Start-End: 172-306
atccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaagtgtaggtagaagtttagcactgcagtcatcagaagaggcaagattaatttccttgacattgaggagttgttggataattactaaatttgtccttgttaaataaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgc

SEQ ID NO: 140785 - DNA, 2126 bp, Homo sapiens
  Payload ID: 7610
  Gene Symbol: HMGN5
  Gene Name: high mobility group nucleosome binding domain 5
  Uniprot ID: P82970
  ENST ID: ENST00000358130
  CDS Start-End: 330-1178
aatagcaccgcgagatctgttgaaacattgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 140786 - DNA, 572 bp, Homo sapiens
  Payload ID: 7610
  Gene Symbol: HMGN5
  Gene Name: high mobility group nucleosome binding domain 5
  ENST ID: ENST00000373250
  CDS Start-End: 90-572
gaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaa

SEQ ID NO: 140787 - DNA, 578 bp, Homo sapiens
  Payload ID: 7610
  Gene Symbol: HMGN5
  Gene Name: high mobility group nucleosome binding domain 5
  ENST ID: ENST00000430960
  CDS Start-End: 135-578
tttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagac

SEQ ID NO: 140788 - DNA, 720 bp, Homo sapiens
  Payload ID: 7610
  Gene Symbol: HMGN5
  Gene Name: high mobility group nucleosome binding domain 5
  ENST ID: ENST00000451455
  CDS Start-End: 454-720
gagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagag

SEQ ID NO: 140789 - DNA, 742 bp, Homo sapiens
  Payload ID: 7610
  Gene Symbol: HMGN5
  Gene Name: high mobility group nucleosome binding domain 5
  ENST ID: ENST00000447319
  CDS Start-End: 140-742
ttttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaagatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaa

SEQ ID NO: 140790 - DNA, 859 bp, Homo sapiens
  Payload ID: 7610
  Gene Symbol: HMGN5
  Gene Name: high mobility group nucleosome binding domain 5
  ENST ID: ENST00000436386
  CDS Start-End: 554-859
gatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaa

SEQ ID NO: 140791 - DNA, 6200 bp, Homo sapiens
  Payload ID: 7611
  Gene Symbol: HDX
  Gene Name: highly divergent homeobox
  Uniprot ID: Q7Z353
  ENST ID: ENST00000297977
  CDS Start-End: 113-2185
attgtctgaagcggcactggagacccaggaaaaatctcgctgaatccgcctgccccagcagcggcctgatctgggttccgctgattcctttcgtaaccgcaccacacccgagatgaatctacgttctgtatttactgtagaacaacaaaggattttacagcgttattatgaaaatggaatgacaaatcaaagtaaaaattgctttcagctcatattacagtgtgcacaggagactaagctggacttcagtgtagtcaggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaatgttgtcaaaattagtcttgatggggattcttcattactacaaatgacaagtattgatacgattgacattccagtagtaaatttgtatacctgggttagatgaagtgttacacaaatattttaaatttatcaccatctttataattcttttttagttcttacatgttatgaaacaggaagtcaaggtaagctgctgagattttttaaaaatttagtcattcagctttgccacaaaatttacctcatttccatatgaggcctgtacagagccatcagccaaggatagtattcaaaaagagttatactactttggttgtaaatcacagtcttctgaattccatgaatactattctatgagtacacacctaaaatgggcaagctacccagttttctattattagtaggtaccagatggcaacacactgtagactgttctttgtagttcttcctttctggagtaccagatggtattaccaagacccatagaagaaaaaatgtcagtttctccctaagcccacagtgtcatatatttgtgacttggcagtgtgcaattgtgttgcatggttaaattactatctatacctaaaagattaatgaagtagctggatggctgtttcagccatcaagtttctgtttccaatttgtttttaatttttgttggtacctagtaggtattcagatatttttaaaaatttgtaattagagccaaatttgatcttgaaatttactagtactaacttatgaacacagaaaggcagtcataaatgtctttacccttgaagtgtcccatcctcccacacacacaaataggtaagctcccactgatagtctttcattttgtcacttatttgtttatattgctgccatactactgatatggtccctttgttagtaggaatatttcagtgttcagatatgcttccttgagccatatggagttttgcaaacaatagttagtttttcttgctgacaagtcaaattccattcagagaaagcagcagagagtaacagagcctcagatattacgattaaatgtaccagtcacaccaactcctccatgagatgaagagtcgcccccatatacaacgaagttagaaaccacttattaagtagcatgaacaaattccaggccttcaagtctctcctagggtctgcttcatagtcattgagtttatctttcaaatataattacttctgcttcaatttaagccccttcttatttggttctcattgcaaattaactataggtatattctctcctacagcttttaacactatagattttatttgtcacgcatcagccattagtcactaaatcgaaaaatacttgttgagctcctgctatagagaagacactgtgctggacattggatttctcagcaagctgtaaacatcacaaataattatttctttttaacatcttctatgatattaataaaccatatttaagtagaatttttaatagatttaaggttctgctaggtgtgattcttagaaggattcctagtccacaattttgagagaaagcatagatgatctttttgtctctgtttaacatttcatcaaaatagaaactatataaatcataacaatacatttagaactccttttgtcttgaaatttgtgtttcagcaccagaatatttttcttcaccatcattggaattaaaacacttctaaaatgaaatgtggctattctgtagcaggaactgaaggaaatacctctatctatagaaaaagaatcataattgccagattgaaattattcatggtagactttgaaaaagatgtcaaggtcaagctttgaaaagttgttatgaagaaagtatattttttacatatgtagataggagttggttttgagatatgttagagcaggaaaaattatcagcttataattactcttgtggacatcttcatggctggggataaaaattaactaactagtgtttctttctttagggctttgagattattaaaacagaccttactatctgaaggctctctcagggagacagaagccaatgtggaaaaaaacaaaaaacaaaaaacaacaacaagaaaaaacttctttttttctttcaactacatttctatgtctgctttaagcttagaacagccaagcagtttttaagccagaaatgtgtatgtaagagcacttaccttccaaaatgtgtacatatgaaaaaaaaaggaaggtattttcttcttttcagccaagctaaacttattcacaagaaaatgagaattgcaattgctctggagaataggaaaattagcacatgcaaagaaaaccttaaaagaaaattggcctcttcatggaaactggggatgttttgtcctaaggtcagttatcaacagcaggatttttgtattgccattgcaagcatgtgatagaaatgtttgttattgttggagaagaaaaggctgagacccaattataccctgtactctttattcgaccaagacctcaaaagatgtcaaagaagccatttctccaaagacagcaacatctattgtgaggcactttcatattcagcagtctgtaagtttgtaggagaaaacataagtggttaatttaaaataattttgggctctaaaatggactttgttgccttttttggtgggggtggtgggaatcggattcagcccatttccaagggatagtttcttcatctcagacaactattttgtgatcctttttaaaagacattctgaaaactttaactcctgcccttcttccgtattacagttgtgttattccagaaatattgtctacttttttaatatattagattttcattcagatcttaaacatgcaaacatgtgataggttagctttttaagggagttatcagtaccactgtatctaaatgttaggtaaatgggtagatttctctttgaagttggtattttccttggcagacagcactgtatcatgctcttcaccaagctatgctctgtaatgctataatcaaggaggctactaacttgtgaacctacagtcaacacaccattgctgaaaacaaactttgattaagaacagatttgctagggggaaaaaagagtaaagtgatattttcaagcaaatataattaaaattgtttcattaaaatatatactgagtgtatattgctccacactgaaattttattttgcattaacttgttaagtaattcattttagcaatcctgcatcccattttactagtactacctctgaaatatactgtcaccttaaaaccacatcagactgtaatgtgaatttttgtagagtttttatttaaacttttatagaggcaataaatgatttccaactaataga

SEQ ID NO: 140792 - DNA, 2924 bp, Homo sapiens
  Payload ID: 7611
  Gene Symbol: HDX
  Gene Name: highly divergent homeobox
  Uniprot ID: Q7Z353
  ENST ID: ENST00000373177
  CDS Start-End: 160-2232
ggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggatgaatctacgttctgtatttactgtagaacaacaaaggattttacagcgttattatgaaaatggaatgacaaatcaaagtaaaaattgctttcagctcatattacagtgtgcacaggagactaagctggacttcagtgtagtcaggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaa

SEQ ID NO: 140793 - DNA, 786 bp, Homo sapiens
  Payload ID: 7611
  Gene Symbol: HDX
  Gene Name: highly divergent homeobox
  ENST ID: ENST00000449553
  CDS Start-End: 166-786
aattgatgatcggacacgctgatttcattgtctgaagcggcactggagacccaggaaaaatctcgctgaatccgcctgccccagcagcggcctgatctgggttccgctgattcctttcgtaaccgcaccacacccgagacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtg

SEQ ID NO: 140794 - DNA, 6158 bp, Homo sapiens
  Payload ID: 7611
  Gene Symbol: HDX
  Gene Name: highly divergent homeobox
  Uniprot ID: Q7Z353
  ENST ID: ENST00000506585
  CDS Start-End: 249-2147
attgtctgaagcggcactggagacccaggaaaaatctcgctgaatccgcctgccccagcagcggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaatgttgtcaaaattagtcttgatggggattcttcattactacaaatgacaagtattgatacgattgacattccagtagtaaatttgtatacctgggttagatgaagtgttacacaaatattttaaatttatcaccatctttataattcttttttagttcttacatgttatgaaacaggaagtcaaggtaagctgctgagattttttaaaaatttagtcattcagctttgccacaaaatttacctcatttccatatgaggcctgtacagagccatcagccaaggatagtattcaaaaagagttatactactttggttgtaaatcacagtcttctgaattccatgaatactattctatgagtacacacctaaaatgggcaagctacccagttttctattattagtaggtaccagatggcaacacactgtagactgttctttgtagttcttcctttctggagtaccagatggtattaccaagacccatagaagaaaaaatgtcagtttctccctaagcccacagtgtcatatatttgtgacttggcagtgtgcaattgtgttgcatggttaaattactatctatacctaaaagattaatgaagtagctggatggctgtttcagccatcaagtttctgtttccaatttgtttttaatttttgttggtacctagtaggtattcagatatttttaaaaatttgtaattagagccaaatttgatcttgaaatttactagtactaacttatgaacacagaaaggcagtcataaatgtctttacccttgaagtgtcccatcctcccacacacacaaataggtaagctcccactgatagtctttcattttgtcacttatttgtttatattgctgccatactactgatatggtccctttgttagtaggaatatttcagtgttcagatatgcttccttgagccatatggagttttgcaaacaatagttagtttttcttgctgacaagtcaaattccattcagagaaagcagcagagagtaacagagcctcagatattacgattaaatgtaccagtcacaccaactcctccatgagatgaagagtcgcccccatatacaacgaagttagaaaccacttattaagtagcatgaacaaattccaggccttcaagtctctcctagggtctgcttcatagtcattgagtttatctttcaaatataattacttctgcttcaatttaagccccttcttatttggttctcattgcaaattaactataggtatattctctcctacagcttttaacactatagattttatttgtcacgcatcagccattagtcactaaatcgaaaaatacttgttgagctcctgctatagagaagacactgtgctggacattggatttctcagcaagctgtaaacatcacaaataattatttctttttaacatcttctatgatattaataaaccatatttaagtagaatttttaatagatttaaggttctgctaggtgtgattcttagaaggattcctagtccacaattttgagagaaagcatagatgatctttttgtctctgtttaacatttcatcaaaatagaaactatataaatcataacaatacatttagaactccttttgtcttgaaatttgtgtttcagcaccagaatatttttcttcaccatcattggaattaaaacacttctaaaatgaaatgtggctattctgtagcaggaactgaaggaaatacctctatctatagaaaaagaatcataattgccagattgaaattattcatggtagactttgaaaaagatgtcaaggtcaagctttgaaaagttgttatgaagaaagtatattttttacatatgtagataggagttggttttgagatatgttagagcaggaaaaattatcagcttataattactcttgtggacatcttcatggctggggataaaaattaactaactagtgtttctttctttagggctttgagattattaaaacagaccttactatctgaaggctctctcagggagacagaagccaatgtggaaaaaaacaaaaaacaaaaaacaacaacaagaaaaaacttctttttttctttcaactacatttctatgtctgctttaagcttagaacagccaagcagtttttaagccagaaatgtgtatgtaagagcacttaccttccaaaatgtgtacatatgaaaaaaaaaggaaggtattttcttcttttcagccaagctaaacttattcacaagaaaatgagaattgcaattgctctggagaataggaaaattagcacatgcaaagaaaaccttaaaagaaaattggcctcttcatggaaactggggatgttttgtcctaaggtcagttatcaacagcaggatttttgtattgccattgcaagcatgtgatagaaatgtttgttattgttggagaagaaaaggctgagacccaattataccctgtactctttattcgaccaagacctcaaaagatgtcaaagaagccatttctccaaagacagcaacatctattgtgaggcactttcatattcagcagtctgtaagtttgtaggagaaaacataagtggttaatttaaaataattttgggctctaaaatggactttgttgccttttttggtgggggtggtgggaatcggattcagcccatttccaagggatagtttcttcatctcagacaactattttgtgatcctttttaaaagacattctgaaaactttaactcctgcccttcttccgtattacagttgtgttattccagaaatattgtctacttttttaatatattagattttcattcagatcttaaacatgcaaacatgtgataggttagctttttaagggagttatcagtaccactgtatctaaatgttaggtaaatgggtagatttctctttgaagttggtattttccttggcagacagcactgtatcatgctcttcaccaagctatgctctgtaatgctataatcaaggaggctactaacttgtgaacctacagtcaacacaccattgctgaaaacaaactttgattaagaacagatttgctagggggaaaaaagagtaaagtgatattttcaagcaaatataattaaaattgtttcattaaaatatatactgagtgtatattgctccacactgaaattttattttgcattaacttgttaagtaattcattttagcaatcctgcatcccattttactagtactacctctgaaatatactgtcaccttaaaaccacatcagactgtaatgtgaatttttgtagagtttttatttaaacttttatagaggcaataaatgatttccaactaa

SEQ ID NO: 140795 - DNA, 1468 bp, Homo sapiens
  Payload ID: 7612
  Gene Symbol: HPCA
  Gene Name: hippocalcin
  Uniprot ID: P84074
  ENST ID: ENST00000373467
  CDS Start-End: 103-684
gcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgca

SEQ ID NO: 140796 - DNA, 4856 bp, Homo sapiens
  Payload ID: 7613
  Gene Symbol: HPCAL4
  Gene Name: hippocalcin like 4
  Uniprot ID: Q9UM19
  ENST ID: ENST00000372844
  CDS Start-End: 393-968
ccccagacttgtaagccgggggctgagcctcagggcaggggtgcagatgggggtgcagccctcccgcttcccggcgactccgggaaggtcagcgcgggcaggcggggcgcgctcctgcggccgggcctcgccggccacccggtccccacctgaaaccccgcctgccactccgctccagaggagccaatagccgtgcaacctgcccgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 140797 - DNA, 4758 bp, Homo sapiens
  Payload ID: 7613
  Gene Symbol: HPCAL4
  Gene Name: hippocalcin like 4
  Uniprot ID: Q9UM19
  ENST ID: ENST00000617690
  CDS Start-End: 295-870
cgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggcggcagcaactgaagagcccacccctgggcaggagaccccccacctcagtccaggcccatgggtgcagagaaggaggcagagccgcctacttatccccagctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaagttcttcccctacggcgacgcctccaagttcgcgcagcacgctttccgcaccttcgacaagaacggcgacggcaccatcgacttccgggagttcatctgcgccctgtcggtcacctcccgcggcagcttcgagcagaagctcaactgggcctttgagatgtacgacctggacggcgacgggcgcatcacgcgcctggagatgctggagatcatcgaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 140798 - DNA, 4436 bp, Homo sapiens
  Payload ID: 7613
  Gene Symbol: HPCAL4
  Gene Name: hippocalcin like 4
  ENST ID: ENST00000612703
  CDS Start-End: 189-548
cgggatggggcggggcttatgcaaatagtgtcgccttcgggaggcacatagtgatacaagagctggaaggcggctccggcgcagaccttggagagcacagctgccggcccgcgagccagcctcggttcccgcggcccgccgaggctcggagccatccagcgacccggcgaccggcctcaggccccgccatggggaagaccaacagcaagctggcccccgaggtgctggaggaccttgttcagaacactgagttcagcgagcaggagctgaagcagtggtacaagggcttcctgaaggactgccccagcggcatcctcaacctggaggagtttcagcagctctacatcaaggcaatctacaagatggtgggcaccgtgatcatgatgcgcatgaaccaggacgggctcacgccccagcagcgtgtggacaagatcttcaagaagatggaccaggataaggacgaccagattacattggaggagttcaaggaggcagccaagagtgacccatccattgtgttgctgctgcagtgtgacatgcagaagtagaagctggtgaggggcagggtccctggccagaaggggcatggccacctcccaacctgatgacctctctggctggcctcccaggaggagggacactccagcccccctctctggcccacccagtcctctgcccaagcccttcctcccctccatcaagatctttgagggaccacctcaccctgcaaaagagacaggtcctccagtaccctgtcttctagccccacctcccacttggccagaaccaatgtccattgggcataggggagttggcttttgccccaggaggtgaggttaaggagttgggggcctggggttctggttaggaattctcttgatcctgggattatgctttataggatgtggtcccacaggcctgtcacagggccaaattgggtctgtccattcctgaggctccagatcccataaagggggtctcttccccatcccttctactctacctggcccttccagccccagcctttggagcgttcattcagtcctttcttcagctaatgattactgagcacctgtttggtgctaaggatatggtcatttacaagacacatcttgtgccctctggaagctcatagggttgtgaggcaaacttccagccgtcagggtctcagctaagcagaaggtgctggaaggctggttagtctgggaggagctatttcatcttccagctcagctccacacaaagctgcagaaggacgaaatgaaaagcatttggaagtttaggagccacgtgagtgaaagttttaagaaaaatgaaatttatgtcatacttatttttttagtaccctttaaaggagctacagtcattttattatttcaggaggttaaaatatactctatattacttggtttcttataaaatgattaaatgaatagagaaaatattaattttcaaggggaaaaaacctgagaagaaagggagaaaagaccatgaaatttaccagataacactttttaagactaagtcctgagctgccactctcagcagtttttgctgcttcagctcttcctttttattacctttttcaattcaacaagcaactttctgctacatacttactccggttgggtgctgacttcagggacaggaaaaagcaaggtttgcaaagagtgaaactagtgtatattccgtatcttggtagttcgtttctggattgggtttagtttcagaactggacttgttccttcactgccacagaatcagaaagagctagaagaaaaggctcacctggccactgtttaggcacccagacataatttatggacgaaatgcctaaaaatgtgccaggcatgctctgtttgagaggctttttctaaccccaaatcttagatctgccaggtagttcaacatcttccaagtgtgctggttctgctttccaatgcctgcttcccaattttggatccatgagctatacagctgcatgctttgactgccggaaaaattaatcttgcttcttcatcaggtctttctcctgtacttgtgatcagaaattacctttgacgtgcagtgacagttgatttcctcttgaactgccggtgaaaacagtctagtacacaggtgctgtcagcccagggtgggagcaggaaatgattgctgagcccggggcaggggaattgcatctgcaggaaagagatgcagcatgctcctcactcctgagtgcccacctgtcctgcttctctgcaggtgaaaactctgggggatgctgatcaatagagcttggtcccaagctctactgggcccttggaggtagcaaggccactgggttgctatcctcttgctggggatagcaaccactggtttgcaaccactgggttgctatccttttgctatcctcttgctcatgaccagccatatggtgaggctggggagttcacatcctcaggcaggaactagcagttgtttatccagcaatgcctcaaggatgttgcattgctcccaggaactggctattaggtatgtcttgtgcggtcagtcagcatcacagacacatagatgctcaccagcctggcttagctgggacctaaatcttctggtgaaaagcttttcactaagtgaggttccttccctgcaaatgctgaatctagcctaattcgcaaccacacagaatttcatggctttcaaaggcttgccatgtgccccatctcattctatactcacatcccatggaggtgaggattttcacttcttttctctagacttggaagctgagattcagagaggaagcatcccttgtgcaagatcacatagtcaggaggtgacacagggctaagacttgaaccaaggctctaagaggatttcttcttttcagagtctcttccctgtccatttctgtgactaagctgtgcagaggttgacagcagggcaagttacattgatattcatcctttataggcttcctgctaaaaagcttctgagattgtggtcttccaaaaaaaataggagcttggttgaagtccccacattttcaagcactcagtgttctgcctctggcagctgtgctaacagctcagtgctgtcctgggagtcctctgactcagaaccctcgaagcatcctgcattgtctttacccaccatcatcttcactaagagaaacatgcctacccatgaaggcgtgtttgattactccaggcttctggacacacatacccatgggtgatttttgctcctcaggcccaatattctcagacagcccagcagtgtgaacacacaatgccaggccaggaactgggaccaccatcttgctgatggaaggaacaacaggtggcccaggacatgctcctgcatactcctgggtgtcccagggactgtgtgctcaggagcactgtggtagagcactggccctgccttgagaagagacacaggtctcccgtccctgcaccagctgagagagacttgccgcaaagcacaaggctggcagagatttatgtatgacttgcacagacacaaaaatatacagacaatcaaaacattgatatattcaaactctcctttaaattccaatcttattgcaacaactctgtgaattgcaaggtcccagaatctgccttctcacatactctaccctcattcatccttttgggctaattgatgagcatcttatttcttatctctaaaaattatcagcaaaggctacttcagatggccactttagtcctttcagctgtagtcaggattatttaacttacctgtatatcaaaagtgaagaaaaagttagttcataagtaaaggcactaaatcctttcctgacaatggcagagtctctagaggtagaaatttgccttgctgcagagagagaaggaatggcgtgggatgggggaaagaaaagaaagagaagaagctggggtctccaggcagggtagtaagctgacactaaatattttttacacaaaaatgtattgaagcaacaaatatttcctgaagatccaccctgggtgaggctttgagctgactttagagatcactgtggggtcaagaatgtcttacatgttttattcatcattcttgaaaaaagaaataattcaaaccttggaattaaaaagtcagaaaaatatgggattttctttctggaattttcgaggttttctttttacctttgccagagtgtgggggcaggactgggcctgccagggtgtatagcccttcctgcttggtggaggccagtcaggcccagggccttctaagcagcagtagaaaggaggcttggggaagtggggggtctgggtagcaggggaaggaggccagttccagtgtagccccctatcccctccagatgtgctgcttctggctgtgcactcagtgactgccctcactgctcaaccctgtgctgtgtggtgtgtttctttccccactgacagtgaataaaaggtgcaactgtg

SEQ ID NO: 140799 - DNA, 1751 bp, Homo sapiens
  Payload ID: 7614
  Gene Symbol: HPCAL1
  Gene Name: hippocalcin-like 1
  Uniprot ID: P37235
  ENST ID: ENST00000307845
  CDS Start-End: 382-963
cgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggca

SEQ ID NO: 140800 - DNA, 1904 bp, Homo sapiens
  Payload ID: 7614
  Gene Symbol: HPCAL1
  Gene Name: hippocalcin-like 1
  Uniprot ID: P37235
  ENST ID: ENST00000381765
  CDS Start-End: 527-1108
agcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagggcatggtctagtggcccagtcaggacgcggaaacactccctggaggttctgacccactccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 140801 - DNA, 587 bp, Homo sapiens
  Payload ID: 7614
  Gene Symbol: HPCAL1
  Gene Name: hippocalcin-like 1
  ENST ID: ENST00000422133
  CDS Start-End: 1-310
gctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacgtgtccctggggaagccacccatggtcactcgctgcccgaatctgcctcctggcttggccctgcccacctcttcagagggcatcttctaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacat

SEQ ID NO: 140802 - DNA, 586 bp, Homo sapiens
  Payload ID: 7614
  Gene Symbol: HPCAL1
  Gene Name: hippocalcin-like 1
  ENST ID: ENST00000423674
  CDS Start-End: 497-586
cttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctgctggagaactcctggaacctttaagccctggctcagccctcagctctgtcccatcccagctgacctctgtgctctgcgcccgagctcctgagcccacgtgtagtcgccgccgccagccgccatgggcaaacagaacagcaagctgcggcccgaggtgctgcaggacctgcgggagaacacggagttcaccgaccacgagctgcaggagtgg

SEQ ID NO: 140803 - DNA, 4781 bp, Homo sapiens
  Payload ID: 7614
  Gene Symbol: HPCAL1
  Gene Name: hippocalcin-like 1
  ENST ID: ENST00000419810
  CDS Start-End: 500-1027
agggaaggggacggagttctctggagtcaggtctggggccaggagacctggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgggcatggtctagtggcccagtcaggacgcggaaacactccctggaggttctgacccactccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtgga

SEQ ID NO: 140804 - DNA, 1547 bp, Homo sapiens
  Payload ID: 7614
  Gene Symbol: HPCAL1
  Gene Name: hippocalcin-like 1
  Uniprot ID: P37235
  ENST ID: ENST00000613496
  CDS Start-End: 171-752
ggtggtggccgcccttggggagctggcctctcagcacagcgccgggcaccggggctcaaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 140805 - DNA, 1535 bp, Homo sapiens
  Payload ID: 7614
  Gene Symbol: HPCAL1
  Gene Name: hippocalcin-like 1
  Uniprot ID: P37235
  ENST ID: ENST00000622018
  CDS Start-End: 159-740
tatgctgtgttcggggctgtctgtcggcgccacagggaatgggggctggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 140806 - DNA, 1941 bp, Homo sapiens
  Payload ID: 7614
  Gene Symbol: HPCAL1
  Gene Name: hippocalcin-like 1
  Uniprot ID: P37235
  ENST ID: ENST00000620771
  CDS Start-End: 565-1146
actgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctg

SEQ ID NO: 140807 - DNA, 2777 bp, Homo sapiens
  Payload ID: 7615
  Gene Symbol: HIAT1
  Gene Name: hippocampus abundant transcript 1
  Uniprot ID: Q96MC6
  ENST ID: ENST00000370152
  CDS Start-End: 137-1609
aggcaggccgggccctcaagatggcggcgggcgcccagagcggctcggcccggcagtagtggtgggacggcactagctgctggggcctgccgccccgggagtggctgcagcagcgccaggaatcgaggatggtaaaatgacccaggggaagaagaagaaacgggccgcgaaccgcagtatcatgctggccaagaagatcatcattaaggacggaggcacgcctcaaggaataggttctcctagtgtctatcatgcagttatcgtcatctttttggagttttttgcttggggactattgacagcacccaccttggtggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgattttttttttaaaaaa

SEQ ID NO: 140808 - DNA, 467 bp, Homo sapiens
  Payload ID: 7615
  Gene Symbol: HIAT1
  Gene Name: hippocampus abundant transcript 1
  ENST ID: ENST00000421661
  CDS Start-End: 1-361
acatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtatgtatgtttattctataccttttgtatctgctgagaaatgccttgtttttaagataaatattattataaggagtgcaaacctttgcattacaagatttttgcgtaaaatatattttgtaataaaatcattcattagactacatttaaaatttttttgcggtat

SEQ ID NO: 140809 - DNA, 3420 bp, Homo sapiens
  Payload ID: 7616
  Gene Symbol: HIATL1
  Gene Name: hippocampus abundant transcript-like 1
  Uniprot ID: Q5SR56
  ENST ID: ENST00000375344
  CDS Start-End: 270-1790
cccgcccctgacgccgccggtaactgcgagagtcggggtcggtgcggtttgataagtggtcggttcctggagctgcggtcttctgctagcctgatccgcagcttcagcctccgccgcctcctcagccctcggcgccgccgctggcgccgccgcctgacccgcaggccgccgcgggccgcagagcccatgagggcgcgggcaccgccgccgcctccgcggcgtcgccgtcgtcccggagcgccccgggctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgttttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttacttttatgtcttgtgtcttttttttaaagcaaatagtattgctcttttgggttctctgttgggtggctttcaattaaactgagttgtaatctttcagctgatgcaaaaggtatgtattttcaaaaaaa

SEQ ID NO: 140810 - DNA, 2275 bp, Homo sapiens
  Payload ID: 7616
  Gene Symbol: HIATL1
  Gene Name: hippocampus abundant transcript-like 1
  ENST ID: ENST00000428393
  CDS Start-End: 126-599
tcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggatttaggagttgcccaggggatcataactggaataagaggactatgcaatggcctgggccagcactgtatggcttcatattctacatgttccatgtggaactgactgagttgggcccgaaattgaattctaacaacgttcccctgcaggggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgttttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttt

SEQ ID NO: 140811 - DNA, 619 bp, Homo sapiens
  Payload ID: 7617
  Gene Symbol: HIATL2
  Gene Name: hippocampus abundant transcript-like 2
  Uniprot ID: Q5VZR4
  ENST ID: ENST00000375223
  CDS Start-End: 215-619
gcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgccaggcgtga

SEQ ID NO: 140812 - DNA, 786 bp, Homo sapiens
  Payload ID: 7617
  Gene Symbol: HIATL2
  Gene Name: hippocampus abundant transcript-like 2
  ENST ID: ENST00000602917
  CDS Start-End: 215-667
gcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgccgggtgtggtggcgtgcacctgtagtcccagctacctgtggcaggagaatggcttgaacccaggaagcggaggttgcagtgagccaagatcacaccattgcactccagcctaggcatggtgagactccatctcaaaaaaaaaaaaaaattaaattgtattgattttctcttttcaa

SEQ ID NO: 140813 - DNA, 3388 bp, Homo sapiens
  Payload ID: 7618
  Gene Symbol: HIRIP3
  Gene Name: HIRA interacting protein 3
  Uniprot ID: Q9BW71
  ENST ID: ENST00000279392
  CDS Start-End: 832-2502
cgcgccaggcctcatcccccacagccttcccgcggcagcactcacgtagatgaggaacttgagcttccgcttcagattccggtatttttttttgtagtccacttcgccgtccgccggcccgttcatgaccggcccgggagtggcgcccagagtctgccctcccgctaccccaagcagtggctgccgtgccgctcccgcctccacttccggagacgctgcaaggctgtgccgtcaggactacaactcccggcgtaccccgcgctcaggggcgtcaccgcacgggccgacctcccgggggacactgggacaggagcgcggcagccactgcgctggggatggcgtagcagcgacgcggtgacgccacaaaaatggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcatcaaatttggtcccccattctcacctcctgtattttgggccaggaaactgagcagtagtcactgcctccacctcctcccctggcctggttccctttaatttcccccgggttcctggaagaagtccctgcctccagaccctgtcatccaacagccaccagacccttttggagaagggtgtgtggctcctgtgctgcccgcctaccccgtggcccctctgcttttagcctagtctgataacctaatgcccacttgggagagggatagaatgacttgagggcagccagtgcttaagccttctcccttatgcaaacagccactttgtccatgggctgttagcctcaaaggggtggggaaaagcccatacctcctgggccagtcctagccctctaggcctctggctacaggcccagcctctgcagtcacatgaggtctccactgaactctggctgctgaggcttgcgggaagattcgtgagcatggagctgcctggggtctgtgtgggaggcaaacctaagaatctttgaagtcaaagcaaagaaaacgaattagaggtcaaggggttgaagaccacctttgagatccgagatctggtcacacctaaagtcattaaaatcactgaaatgtttagatacacagcccaataaattctctttataaaacacaagcagtacta

SEQ ID NO: 140814 - DNA, 988 bp, Homo sapiens
  Payload ID: 7618
  Gene Symbol: HIRIP3
  Gene Name: HIRA interacting protein 3
  Uniprot ID: Q9BW71
  ENST ID: ENST00000564026
  CDS Start-End: 39-566
aaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcgggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcatcaaa

SEQ ID NO: 140815 - DNA, 504 bp, Homo sapiens
  Payload ID: 7619
  Gene Symbol: HNMT
  Gene Name: histamine N-methyltransferase
  Uniprot ID: P50135
  ENST ID: ENST00000280096
  CDS Start-End: 20-175
ctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctactcaaaattctca

SEQ ID NO: 140816 - DNA, 3295 bp, Homo sapiens
  Payload ID: 7619
  Gene Symbol: HNMT
  Gene Name: histamine N-methyltransferase
  Uniprot ID: P50135
  ENST ID: ENST00000280097
  CDS Start-End: 183-1061
gactcagtaatgagctctacaagccagcctttgtggcatgttaaattcaaaacaagcttagcatttttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaactta

SEQ ID NO: 140817 - DNA, 835 bp, Homo sapiens
  Payload ID: 7619
  Gene Symbol: HNMT
  Gene Name: histamine N-methyltransferase
  Uniprot ID: P50135
  ENST ID: ENST00000329366
  CDS Start-End: 183-563
gactcagtaatgagctctacaagccagcctttgtggcatgttaaattcaaaacaagcttagcatttttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcagattgtctcattcggggaagctccagggttctcaagcggaattcgtgtttcattttgtgtagcacccgtcagaaagacaagccaggcatgaggatccatgatgagcgctcttctgagttgccatttggagctgcccgtttagaaagcaaatctgcatttccctcattcctagtttccttcatcctcttttaagtgtcatcttttccatgaagcctactagatcacacagttgaaaattgcaaagtcttcacaccgcagcttcccctttctttgttgctttggttttctccgtgggacttcccaccatccgtaaaattaggtgtttttgcctgttttattcactgctacgtctccaatggttagaacctgacatttagtgggtgctcaataatatttgttgaagtaatgtataataacttcactttcttgagtaattactatatatcatgaactgtggtaaatta

SEQ ID NO: 140818 - DNA, 1150 bp, Homo sapiens
  Payload ID: 7619
  Gene Symbol: HNMT
  Gene Name: histamine N-methyltransferase
  Uniprot ID: P50135
  ENST ID: ENST00000410115
  CDS Start-End: 149-1027
cagtcttccgttaaagatttcactgctgtagatttctgagagtgctgtgtagctgtcctctttatcctggtgtttgccacttcgaacagtcactttcccacttggaacttacttgtggctttgctgacaaaacaggaaaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagat

SEQ ID NO: 140819 - DNA, 743 bp, Homo sapiens
  Payload ID: 7619
  Gene Symbol: HNMT
  Gene Name: histamine N-methyltransferase
  Uniprot ID: P50135
  ENST ID: ENST00000475675
  CDS Start-End: 14-169
cagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagaaatcttcttacgtctagtattctgaaattttaaaatactgagctgtgaaatggttcctttttacccattttatgggtactccctgggctatttcaattgagattcagatccttcagttatgcggaactttggattggagacacaaaatcagaaattaagattctaagcataggcggaggtgcagggcggggccaagatggccgactagaaacagcagcgtttggaggcccccattgaaaaaaaacataagcttgtgaatacttcaccagcaaccaaggcatccaggttctctcatcagaactg

SEQ ID NO: 140820 - DNA, 4711 bp, Homo sapiens
  Payload ID: 7620
  Gene Symbol: HRH1
  Gene Name: histamine receptor H1
  Uniprot ID: P35367
  ENST ID: ENST00000397056
  CDS Start-End: 192-1655
agtattggagtgttacagggagacatacaggatttaagaagcccatcatggagaagaccttcaattacagagataaaaagtttttcttgtgaacaagttacactagatggaagataacagactgaggagtgagctgcttctgactcgattaaaaagggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaagacatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtgggcagatcatttgaggccaggagttcaagaccagtctggccaatatggagaaaccttgtctctactaaaaacacaaaaattatctgggcatggtggggcatgcctgtagtcccacttacttgggaggccgaggcacgagaattgcttgaacccgggaggtggaggttgccgtgagccaagatcacgccactgcactccagcctgggcaacagagcaagactctgtctcaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcatatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaacaaggtctatgcattattgtatacagtgtctctagtgcttgtatagtgtctggtatacagagggcactcctatgcatttttaaaacatgctgagcacataccatgtgccaggctttgtgttttatctaatgttatctaatggtattggtgccattatgtaatgttgcctttacaacaacctcatgagggagatttccatctttacaaataggcaaactgaggcccagagagattgaggaactgctccgaggtctgattctggaatgtgcttcctttccactttatcaatctgctcttcgtactcctgtctgaacgatggaaattaatttttgaatgtataaaagacaacagactatgatacagaaatgtcagccccagcccactaagaaagccccagcccatcagtggctaatggctttaataaattggtcatttggctacttggcttgtggacaatctctgacctcttttgaagatgggcactgcatggacttccaggaggtggatttaatagtcttaactcagcatgaaaaagatgctgggatgctcctggctatttatgcaccctaagtgccatagagacatgctgttggcaaggcatggtggctcatgcctgtaatcccagcacactgggaggctgacgcgggcagatggctggagtccaggagttcgagacaagcctgggcaccatggtgaaatcctgtctctactaaaaataaaaaattagccaggggctgtgacgca

SEQ ID NO: 140821 - DNA, 574 bp, Homo sapiens
  Payload ID: 7620
  Gene Symbol: HRH1
  Gene Name: histamine receptor H1
  ENST ID: ENST00000413416
  CDS Start-End: 537-574
ttcccggcaggagagcagcatttgtaaaggtatggggtgtacacgagcagggcctatttggggagagtggagaatcagagatgaggctgcacagtaaggtgagaccaggtggaaaaagctctgtgtgatgggtcgaaggtattgacatatactagccactgcccggcaccctccctccgtttccggagtagacctgtttgcttatctcgtgggcatttgccaggctgattagagtaatgagtaaagaaaagagggcactgggaaagctaagttcatttatattagaaattacatgatactcttccataaatcagaaagattgaagagtgggtgaaagaagggaaaagggaattaaaggggaaccaaggcaacctgaagtttttgagagagagagcaggaagatttgaggatgagcaggtgatgctgtagctggcgctatgtagcgacagatgggagaagttctttgtgatggttttgcctctttgagagtcttcagtaaagggagtgagccataactggtggctgctcttgcgccaatgagcctccccaattcctcctgcctcttagaagacaa

SEQ ID NO: 140822 - DNA, 4278 bp, Homo sapiens
  Payload ID: 7620
  Gene Symbol: HRH1
  Gene Name: histamine receptor H1
  Uniprot ID: P35367
  ENST ID: ENST00000431010
  CDS Start-End: 63-1526
accaaactttccccggagccggcgccgggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaagacatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtgggcagatcatttgaggccaggagttcaagaccagtctggccaatatggagaaaccttgtctctactaaaaacacaaaaattatctgggcatggtggggcatgcctgtagtcccacttacttgggaggccgaggcacgagaattgcttgaacccgggaggtggaggttgccgtgagccaagatcacgccactgcactccagcctgggcaacagagcaagactctgtctcaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcatatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaacaaggtctatgcattattgtatacagtgtctctagtgcttgtatagtgtctggtatacagagggcactcctatgcatttttaaaacatgctgagcacataccatgtgccaggctttgtgttttatctaatgttatctaatggtattggtgccattatgtaatgttgcctttacaacaacctcatgagggagatttccatctttacaaataggcaaactgaggcccagagagattgaggaactgctccgaggtctgattctggaatgtgcttcctttccactttatcaatctgctcttcgtactcctgtctgaacgatggaaattaatttttgaatgtataaaagacaacagactatgatacagaaatgtcagccccagcccactaagaaagccccagcccatcagtggctaatggctttaataaattggtcatttggcta

SEQ ID NO: 140823 - DNA, 2080 bp, Homo sapiens
  Payload ID: 7620
  Gene Symbol: HRH1
  Gene Name: histamine receptor H1
  Uniprot ID: P35367
  ENST ID: ENST00000438284
  CDS Start-End: 343-1806
atttcaaagcacaccatgccggcagcacttggaggtggtatgtgctgggaaactgaccaacagtttagtcagactgagtcacttcaaggaggggagtggagacagcagtgggtgccagatgacacggagctgtcggcttccgtgtgcattttcttttgatagtagccgtagagaagttgtccgccaggcagccctcaatgggatttttcatttaagaaaaatcactctgctcgtgcactgatggagaaatgaactacaagaagcaagccctgaggtctggagacaggaagctactgaaaccagccagggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataat

SEQ ID NO: 140824 - DNA, 1080 bp, Homo sapiens
  Payload ID: 7621
  Gene Symbol: HRH2
  Gene Name: histamine receptor H2
  Uniprot ID: P25021
  ENST ID: ENST00000231683
  CDS Start-End: 1-1080
atggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaa

SEQ ID NO: 140825 - DNA, 2561 bp, Homo sapiens
  Payload ID: 7621
  Gene Symbol: HRH2
  Gene Name: histamine receptor H2
  Uniprot ID: P25021
  ENST ID: ENST00000377291
  CDS Start-End: 652-1845
gtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacagaccatggctttgccttccagaatgctggtctgtggaactgacccattcattcattcatttgttcattcattcatttgcaaacattcatccaattcccaccacatgccaggaattatgatgaatactggggatgtagaaatgagattttttgggtttatggtgatgaagttacagaaaatcaatggcacagccctggtctcagctctgccgtcactcaacttgtatcttgagcaagttcctccccatctcaggcctcagtttcctcatcgcatagagagttggtcttccctcaccgggcttcctacttgccctccagagttgcctgaagctcacatgagcgaagggacatgaacatgctctgccatctcccaataggacataagtccacgctggagcgctgagcatcagactcaagaaaagcttgcgtggatattgcagacccaccaacaagggctccaggttctggagttgtggaggcaaaactgcctagtgagaaccctacatattccctctggtccttgcagctgccacccccattcccaggggtggagtgtccctccatagacttggatcctgggccctctgctccttcaccactgtccatctgaagcaagcctggttgctccggcactgaactgtggcctcgggccctggaccctgcccctcaaatccaccctccaagtgcacacctggaaacttccgcttccagtcctgatgggtaaaacgcccacctaccatatccttgcgcaatctcttattcaggaggcagctggagtgcaaagctgacttagttcacaaagtataaaaaaatacagggatgtggttcagctagaa

SEQ ID NO: 140826 - DNA, 1419 bp, Homo sapiens
  Payload ID: 7622
  Gene Symbol: HRH3
  Gene Name: histamine receptor H3
  ENST ID: ENST00000317393
  CDS Start-End: 298-1419
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaaaaagatgaagaagaaaacatgtctgtga

SEQ ID NO: 140827 - DNA, 2659 bp, Homo sapiens
  Payload ID: 7622
  Gene Symbol: HRH3
  Gene Name: histamine receptor H3
  Uniprot ID: Q9Y5N1
  ENST ID: ENST00000340177
  CDS Start-End: 286-1623
cggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtattttttta

SEQ ID NO: 140828 - DNA, 900 bp, Homo sapiens
  Payload ID: 7622
  Gene Symbol: HRH3
  Gene Name: histamine receptor H3
  ENST ID: ENST00000611492
  CDS Start-End: 298-900
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagctccggcagctcctcgaggggcactgagaggccgcgctcactcaagaggggctccaagccgtcggcgtcctcggcctcgctggagaagcgcatga

SEQ ID NO: 140829 - DNA, 3668 bp, Homo sapiens
  Payload ID: 7623
  Gene Symbol: HRH4
  Gene Name: histamine receptor H4
  Uniprot ID: Q9H3N8
  ENST ID: ENST00000256906
  CDS Start-End: 101-1273
ggaagactacacattttaggtatgtgattagaaaacatacttgtcagaattgtctggctggattaatttgctaatttgaccttcttcatcatttgatgtgatgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtgggtgtgatctccattcctttgtacatccctcacacgctgttcgaatgggattttggaaaggaaatctgtgtattttggctcactactgactatctgttatgtacagcatctgtatataacattgtcctcatcagctatgatcgatacctgtcagtctcaaatgctgtgtcttatagaactcaacatactggggtcttgaagattgttactctgatggtggccgtttgggtgctggccttcttagtgaatgggccaatgattctagtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaaagacaattttctcacctctgtaaattttagtctcaatctcacctaaatgaatcaggtctgccctttatcttgcccttttcattctaccaacagatctgcactttgaagtcaatggtaaattactccagtgaataatagcagtataatatgacttgataatatttttgtaaacttgtagtcataatagtactatattcttcttagtcctcacctcttccttgtcttttagatcttaatttcatgctgattacaaaaatccagttttgttttctttctatgttccatgcataatacagtcttaagtgaatttctcttttttaattttatcgtaatagaaacttatccagtttgaaaatcattccctaaagcatgcaataggaaaaagaacctcctggctgggactgcccaactctgttctgatcagtgggtgggtgaggtagggtttgagttggcaagagcagggaacgggcatgtgcccaggtgagctcctgtgtgtgtccagattttatattcctaatcccagtaaggaagaaagcgtagtgtgggagaggagagagctgatgactgcagttctcaaaggtcctcagtgaagttattttggaggccctggtggtcacaggatcagaaggcaagggataggcagtggtcaccaatggttgaaagtatggcttgtcccatttcttcctgttctctttttctagcttccacatcagcttccttttttgagaacatatagaagaagaaggctaagagatggtgaagagactgcatgattaaactagatagacctggtatacagtcactgaactagtagatgtcaataattattatttttaaaaatttttatttgttggccgggcatggtggctcacgcctgaaatcccagcactttgggaggccaaggtgggcggatcatgaggtcaggagatcgagaccatcctggccaacatggtgaaaccccatctgtactaaaatacaaacaagtagctggttgtggcgccgcatgcctgtagtcccagctactcgggaggctgaggcaggggaattgcttgaacccgggaggcggagtttgccagcctggcaacagaacaagactctgtctaaaaagaaaaaaaaatttttttgtttaagacagcatcttgctctgtctcccaggctggagcgtagtaatgcaatcatagctcactgcagcctggaactccttggctcaagcaatcctgctgccttggcctcccaagtatgtaggactacaggtactcgccaccacacctggataattaaaaaattatttctgtagagatgaagtctcactgtgttgcccagcctgggtgtcaataattattttttaaaaaaaatttttaaaaaggttttttgagacagattcttgctctgtcacccaggctggagtgcagtagcatgatcagggatcactgcaacctctgcctcctgggttcaagcgattcttgtgcctaagccacctgagcagctgggattacaggtgcatgccaccatgcctggctaattttggtatttttagtagagatgaggttttgccattttggtcaggctggaatttttttttttttaattttgataagacagggtattgccgtgttggccagactggtctcaaactcctgggctgaaacaatcctcccgccttggcctcccaaagtgctgggattataggcacaagacaccacaataattattgcctgtatgtcaattattattttaaaatattgttgtatttacttaatgtctttaatgcatttgcccaatattttacattgtactgctcagaggtattcctttattatgtggttagcataggttatactttgctgacgattcacattttattagtttggttatgttttgtccttttaaaacattttcttttgagatgggggtcttgctctgttgcccacgcaggagtgcagtggcatgctctcagctcactgcagccctgactgcctaggctccagcaatcttcttacgtcagcctccagagtagctgggaccgcaggcacttgccaccacgccccactaaaaattttttaaattgttgcctttcttgaagtgttctctgcctgtctttgtcacaaaatttcatttttctcatagttaatttcatctctccggtaagattttattggtgtttcttttataactttgcagttcttacaccgtttggtgattttcatgtttcttagaaactttaaacctttaacttcaaacattaaaatacaagtcttttaagtacatgagtgcttagaaatgtacataatgtttatatacacttatgccttacattaaagtccaatatgagaaatacatgtttaacattcaataataattttaaaaatttgagaaataaactctcataaatgca

SEQ ID NO: 140830 - DNA, 909 bp, Homo sapiens
  Payload ID: 7623
  Gene Symbol: HRH4
  Gene Name: histamine receptor H4
  Uniprot ID: Q9H3N8
  ENST ID: ENST00000426880
  CDS Start-End: 1-909
atgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtggtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaa

SEQ ID NO: 140831 - DNA, 580 bp, Homo sapiens
  Payload ID: 7624
  Gene Symbol: HTN1
  Gene Name: histatin 1
  Uniprot ID: P15515
  ENST ID: ENST00000246896
  CDS Start-End: 108-281
aacgtgtttaaatacatcagccatatagaaaaggacatctcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcacatta

SEQ ID NO: 140832 - DNA, 623 bp, Homo sapiens
  Payload ID: 7624
  Gene Symbol: HTN1
  Gene Name: histatin 1
  Uniprot ID: P15515
  ENST ID: ENST00000511674
  CDS Start-End: 72-245
atctcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtaagctgactctagttgcttgtctttctagaagtgtcaacactgacagtttaaaaaaaaagccataagctaacaaccattccagtttaagaaatgtagcatgggttagctccttgaagtgtattcatttgtataaatgcttctgaagctgtagatatgtggtgttatttctgaggtctctgttctgtgccattggtctgtatgttgttttggtactggtaccatgctgttttggtaactgtagctttgtagtatagtttgaagtcaggtagtgtgatgccttcagctttgttcttttgcttacaattgtcttgggtatatgagcttttctttggatccatatga

SEQ ID NO: 140833 - DNA, 536 bp, Homo sapiens
  Payload ID: 7624
  Gene Symbol: HTN1
  Gene Name: histatin 1
  Uniprot ID: P15515
  ENST ID: ENST00000610341
  CDS Start-End: 68-241
cttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcac

SEQ ID NO: 140834 - DNA, 623 bp, Homo sapiens; identical to SEQ ID NO: 140832
  Payload ID: 7624
  Gene Symbol: HTN1
  Gene Name: histatin 1
  ENST ID: ENST00000635569
  CDS Start-End: 72-245

SEQ ID NO: 140835 - DNA, 580 bp, Homo sapiens; identical to SEQ ID NO: 140831
  Payload ID: 7624
  Gene Symbol: HTN1
  Gene Name: histatin 1
  ENST ID: ENST00000635327
  CDS Start-End: 108-281

SEQ ID NO: 140836 - DNA, 536 bp, Homo sapiens; identical to SEQ ID NO: 140833
  Payload ID: 7624
  Gene Symbol: HTN1
  Gene Name: histatin 1
  ENST ID: ENST00000634477
  CDS Start-End: 68-241

SEQ ID NO: 140837 - DNA, 493 bp, Homo sapiens
  Payload ID: 7625
  Gene Symbol: HTN3
  Gene Name: histatin 3
  ENST ID: ENST00000381057
  CDS Start-End: 72-197
atctcttgagacttcacttcagcttcactgacttctggattctcctcttgagtaaaaggactcagccaactatgaagttttttgtttttgctttaatcttggctctcatgctttccatgactggagctgattcacatgcaaaggaaaagcatcattcacatcgaggctatagatcaaattatctgtatgacaattgatatcttcagtaatcacggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcacat

SEQ ID NO: 140838 - DNA, 775 bp, Homo sapiens
  Payload ID: 7625
  Gene Symbol: HTN3
  Gene Name: histatin 3
  Uniprot ID: P15516
  ENST ID: ENST00000530128
  CDS Start-End: 76-231
ggacatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcacggggcatgattatggaggtctctgcttgctatctgatctacgacaatcctgacaaaaacaagcaatgggaaaaggatctcctagtcaataaatggtactgggaaaactggctagccatatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaacaaaaaacccgtctaaaagtggacaaaggatatgaacagacact

SEQ ID NO: 140839 - DNA, 578 bp, Homo sapiens
  Payload ID: 7625
  Gene Symbol: HTN3
  Gene Name: histatin 3
  Uniprot ID: P15516
  ENST ID: ENST00000526767
  CDS Start-End: 118-273
gggagatttcaacgtgtttaaatacatcagccatctaggaaaggacatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcacggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcacattattatgtg

SEQ ID NO: 140840 - DNA, 578 bp, Homo sapiens; identical to SEQ ID NO: 140839
  Payload ID: 7625
  Gene Symbol: HTN3
  Gene Name: histatin 3
  ENST ID: ENST00000634949
  CDS Start-End: 118-273

SEQ ID NO: 140841 - DNA, 775 bp, Homo sapiens; identical to SEQ ID NO: 140838
  Payload ID: 7625
  Gene Symbol: HTN3
  Gene Name: histatin 3
  ENST ID: ENST00000635585
  CDS Start-End: 76-231

SEQ ID NO: 140842 - DNA, 493 bp, Homo sapiens; identical to SEQ ID NO: 140837
  Payload ID: 7625
  Gene Symbol: HTN3
  Gene Name: histatin 3
  ENST ID: ENST00000635125
  CDS Start-End: 72-197

SEQ ID NO: 140843 - DNA, 3913 bp, Homo sapiens
  Payload ID: 7626
  Gene Symbol: HAL
  Gene Name: histidine ammonia-lyase
  Uniprot ID: P42357
  ENST ID: ENST00000261208
  CDS Start-End: 370-2343
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcc

SEQ ID NO: 140844 - DNA, 2804 bp, Homo sapiens
  Payload ID: 7626
  Gene Symbol: HAL
  Gene Name: histidine ammonia-lyase
  ENST ID: ENST00000544080
  CDS Start-End: 296-799
agacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgatt

SEQ ID NO: 140845 - DNA, 2637 bp, Homo sapiens
  Payload ID: 7626
  Gene Symbol: HAL
  Gene Name: histidine ammonia-lyase
  Uniprot ID: P42357
  ENST ID: ENST00000538703
  CDS Start-End: 349-2124
agataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttt

SEQ ID NO: 140846 - DNA, 3846 bp, Homo sapiens
  Payload ID: 7626
  Gene Symbol: HAL
  Gene Name: histidine ammonia-lyase
  Uniprot ID: P42357
  ENST ID: ENST00000541929
  CDS Start-End: 927-2276
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcc

SEQ ID NO: 140847 - DNA, 753 bp, Homo sapiens
  Payload ID: 7626
  Gene Symbol: HAL
  Gene Name: histidine ammonia-lyase
  ENST ID: ENST00000548808
  CDS Start-End: 1-463
aagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggcaagctggctccttggcttgtttcttaatttttaattgttacaggaaagcaaagtcggggatggagaaacattgccttattctattgttttctggccattccttgggaatgagcaaaaaggtatttgagcaacaacttgcagcaccactaagaagccatataataaacactaagtgcaccagggtgcagccaacggttgaatatctaaggattagaaacagaaatggattttaaatggagttttgggacaatattcatggggaaaaaaataagatgtcaggttcattgatgcctccccacccctgcaagatgtcctctttgattc

SEQ ID NO: 140848 - DNA, 697 bp, Homo sapiens
  Payload ID: 7626
  Gene Symbol: HAL
  Gene Name: histidine ammonia-lyase
  ENST ID: ENST00000546579
  CDS Start-End: 225-697
ccctggtctctgccctgacacctacctttctgctttttgctctcctcctacataaagatgctaagaccacatgaaaccatctgaagcagttttaaagcagccatttctatagaattcatgggccaatgatgggccgttccttggtttaacagggggaacatggctgtacaatgtgatctgtaacgagtctcccgtgcattgttttagttatagagggtgatgccatgtctcctgacttcattccatctcaaccagaaggagtttatctcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaa

SEQ ID NO: 140849 - DNA, 2271 bp, Homo sapiens
  Payload ID: 7626
  Gene Symbol: HAL
  Gene Name: histidine ammonia-lyase
  ENST ID: ENST00000546999
  CDS Start-End: 230-733
gccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcag

SEQ ID NO: 140850 - DNA, 1026 bp, Homo sapiens
  Payload ID: 7626
  Gene Symbol: HAL
  Gene Name: histidine ammonia-lyase
  ENST ID: ENST00000552509
  CDS Start-End: 19-1026
tcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagatcagaggatgaggcttgggttaccttgcatggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagccttt

SEQ ID NO: 140851 - DNA, 2705 bp, Homo sapiens
  Payload ID: 7627
  Gene Symbol: HDC
  Gene Name: histidine decarboxylase
  Uniprot ID: P19113
  ENST ID: ENST00000267845
  CDS Start-End: 404-2392
gggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaa

SEQ ID NO: 140852 - DNA, 2180 bp, Homo sapiens
  Payload ID: 7627
  Gene Symbol: HDC
  Gene Name: histidine decarboxylase
  Uniprot ID: P19113
  ENST ID: ENST00000543581
  CDS Start-End: 44-1933
tcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagct

SEQ ID NO: 140853 - DNA, 545 bp, Homo sapiens
  Payload ID: 7627
  Gene Symbol: HDC
  Gene Name: histidine decarboxylase
  ENST ID: ENST00000559683
  CDS Start-End: 10-545
gatttctctatgtcacttctagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgact

SEQ ID NO: 140854 - DNA, 2385 bp, Homo sapiens
  Payload ID: 7628
  Gene Symbol: HRC
  Gene Name: histidine rich calcium binding protein
  Uniprot ID: P23327
  ENST ID: ENST00000252825
  CDS Start-End: 188-2287
ctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaa

SEQ ID NO: 140855 - DNA, 303 bp, Homo sapiens
  Payload ID: 7628
  Gene Symbol: HRC
  Gene Name: histidine rich calcium binding protein
  ENST ID: ENST00000598858
  CDS Start-End: 1-289
cagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagggccctggcagacatgctggaaacgccggaaccctgacccagtcgctcgactgcgacgcaggtgtacctccccctgccttccaacccctttccacgagctatatttatttctccgaataaacgtgctccccgaa

SEQ ID NO: 140856 - DNA, 2044 bp, Homo sapiens
  Payload ID: 7628
  Gene Symbol: HRC
  Gene Name: histidine rich calcium binding protein
  ENST ID: ENST00000595625
  CDS Start-End: 7-2037
gtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcactgtcagttctgctatctctgcccgctggtctgcgaaacggtctgcgctccaggaagctacgttgactatttctcctcgtccctttatcaggccctggcagacatgctggaaacgccggaaccctgacccagtc

SEQ ID NO: 140857 - DNA, 950 bp, Homo sapiens
  Payload ID: 7629
  Gene Symbol: HRCT1
  Gene Name: histidine rich carboxyl terminus 1
  Uniprot ID: Q6UXD1
  ENST ID: ENST00000354323
  CDS Start-End: 97-444
aacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcctccaccaccaccaccacccccgccacacccctcaccacctccaccaccaccaccacccccaccgccaccatccccgccacgctcgctgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaagcttt

SEQ ID NO: 140858 - DNA, 1081 bp, Homo sapiens
  Payload ID: 7630
  Gene Symbol: HINT1
  Gene Name: histidine triad nucleotide binding protein 1
  Uniprot ID: P49773
  ENST ID: ENST00000304043
  CDS Start-End: 281-661
gcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttcta

SEQ ID NO: 140859 - DNA, 656 bp, Homo sapiens
  Payload ID: 7630
  Gene Symbol: HINT1
  Gene Name: histidine triad nucleotide binding protein 1
  ENST ID: ENST00000513345
  CDS Start-End: 129-326
gattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgagtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaata

SEQ ID NO: 140860 - DNA, 583 bp, Homo sapiens
  Payload ID: 7630
  Gene Symbol: HINT1
  Gene Name: histidine triad nucleotide binding protein 1
  ENST ID: ENST00000513012
  CDS Start-End: 52-249
ctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgagtgccttgctttccatgacatttcccctcaagcaccaacacattttctggtgatacccaagaaacatatatcccagatttctgtggcagaagatgatgatgaaagtgtaagtacatttctaacatgatttattttcttgctttttaaattgtgagattaattttgtccttaaagtgctgtcacattttcatcttcctaaggtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccagg

SEQ ID NO: 140861 - DNA, 825 bp, Homo sapiens
  Payload ID: 7630
  Gene Symbol: HINT1
  Gene Name: histidine triad nucleotide binding protein 1
  ENST ID: ENST00000508495
  CDS Start-End: 97-333
cgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttata

SEQ ID NO: 140862 - DNA, 619 bp, Homo sapiens
  Payload ID: 7630
  Gene Symbol: HINT1
  Gene Name: histidine triad nucleotide binding protein 1
  ENST ID: ENST00000504202
  CDS Start-End: 16-213
gggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgagtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttgg

SEQ ID NO: 140863 - DNA, 681 bp, Homo sapiens
  Payload ID: 7630
  Gene Symbol: HINT1
  Gene Name: histidine triad nucleotide binding protein 1
  ENST ID: ENST00000506908
  CDS Start-End: 137-373
acgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtaagtacatttctaacatgatttattttcttgctttttaaattgtgagattaattttgtccttaaagtgctgtcacattttcatcttcctaaggtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcagtggcactcggctcactgcaagctccacctccctggtt

SEQ ID NO: 140864 - DNA, 923 bp, Homo sapiens
  Payload ID: 7630
  Gene Symbol: HINT1
  Gene Name: histidine triad nucleotide binding protein 1
  ENST ID: ENST00000511475
  CDS Start-End: 36-347
ctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccttgggcaaaatcatctaatacagagcctattctgtaacagagtgttgaatatctcatgtaagagtattttactgcatatcaccagtctggaaaaggatcagaattcgaagtatggtttctcctgaatgcatatcgccacaccattgtaaagttgaaaaatcataatttccccaacttacaatttttgtccattgtccatctgtacaatggaccttactgcatgagtaagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtc

SEQ ID NO: 140865 - DNA, 703 bp, Homo sapiens
  Payload ID: 7630
  Gene Symbol: HINT1
  Gene Name: histidine triad nucleotide binding protein 1
  ENST ID: ENST00000508488
  CDS Start-End: 121-432
ggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtgtcattactaaggaaaaaccagaaaaaccattaggacttcaactgcccagctgttttccaaagttactgcatcattttgtatcccaccagcaatgaatgagcgttccagcttctccgtatccttatcaacacttgctattaccttttttttttttttttgagacagagtcttgctctgtcgcccaggctgcagtgcagtggcactcggctcactgcaagctccacctccctggttcacaccattctcctgcctcagcctcccgagtagtgggacaacaggcgcccgccaccaaggctggctaattttttgtatttttagtagagacggctttcaccatgttagtcaggatagtttcgatttcctgac

SEQ ID NO: 140866 - DNA, 82 bp, Homo sapiens
  Payload ID: 7630
  Gene Symbol: HINT1
  Gene Name: histidine triad nucleotide binding protein 1
  ENST ID: ENST00000520028
  CDS Start-End: 1-82
tgatacccaagaaacatatatcccagatttctgtggcagaagatgatgatgaaagttgctgtcacattttcatcttcctaag

SEQ ID NO: 140867 - DNA, 628 bp, Homo sapiens
  Payload ID: 7631
  Gene Symbol: HINT2
  Gene Name: histidine triad nucleotide binding protein 2
  Uniprot ID: Q9BX68
  ENST ID: ENST00000259667
  CDS Start-End: 43-534
cgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 140868 - DNA, 3314 bp, Homo sapiens
  Payload ID: 7632
  Gene Symbol: HINT3
  Gene Name: histidine triad nucleotide binding protein 3
  Uniprot ID: Q9NQE9
  ENST ID: ENST00000229633
  CDS Start-End: 198-746
gccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatggcggaggaacaggtgaaccgcagcgccggcctggcccccgactgtgaggcctcggcgactgcagaaactacggtttcctcagtggggacctgtgaagccgctggcaagtcaccagagcccaaggactacgacagcacctgcgtgttctgccggatcgcggggcggcaggacccgggcaccgaactcctgcactgcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagtactttgtgggaacctttattactgtgaaggagaaaaatagctatttcttgacagttctatagttatacacataaattttcaaaataaagaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatagttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaggctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaaaaatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagtggtatcaagagcattgtttatgcatgttgtgatactatttgtggaactgtttaatgagctatttcaaactgctagaagaaaatgaaataaaaatggaaaaatactgtcaaa

SEQ ID NO: 140869 - DNA, 2015 bp, Homo sapiens
  Payload ID: 7633
  Gene Symbol: HRG
  Gene Name: histidine-rich glycoprotein
  Uniprot ID: P04196
  ENST ID: ENST00000232003
  CDS Start-End: 81-1658
ttaatcaattgcgtgtgtttcagaaagtctgtataaaattctctgcagtggcagatcatagcaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacaatcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactattgtta

SEQ ID NO: 140870 - DNA, 1780 bp, Homo sapiens
  Payload ID: 7634
  Gene Symbol: HARS
  Gene Name: histidyl-tRNA synthetase
  Uniprot ID: P12081
  ENST ID: ENST00000307633
  CDS Start-End: 80-1429
atagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgg

SEQ ID NO: 140871 - DNA, 1896 bp, Homo sapiens
  Payload ID: 7634
  Gene Symbol: HARS
  Gene Name: histidyl-tRNA synthetase
  Uniprot ID: P12081
  ENST ID: ENST00000457527
  CDS Start-End: 74-1543
ggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggag

SEQ ID NO: 140872 - DNA, 1774 bp, Homo sapiens
  Payload ID: 7634
  Gene Symbol: HARS
  Gene Name: histidyl-tRNA synthetase
  ENST ID: ENST00000431330
  CDS Start-End: 234-1421
gaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggag

SEQ ID NO: 140873 - DNA, 1401 bp, Homo sapiens
  Payload ID: 7634
  Gene Symbol: HARS
  Gene Name: histidyl-tRNA synthetase
  ENST ID: ENST00000415192
  CDS Start-End: 38-1345
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagac

SEQ ID NO: 140874 - DNA, 1789 bp, Homo sapiens
  Payload ID: 7634
  Gene Symbol: HARS
  Gene Name: histidyl-tRNA synthetase
  Uniprot ID: P12081
  ENST ID: ENST00000438307
  CDS Start-End: 38-1447
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcct

SEQ ID NO: 140875 - DNA, 580 bp, Homo sapiens
  Payload ID: 7634
  Gene Symbol: HARS
  Gene Name: histidyl-tRNA synthetase
  ENST ID: ENST00000512396
  CDS Start-End: 38-220
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagtagagacgaggtttcaccatgttggccaggctggtctcgaacccctgacctcaggcaatccatctgccttggcctcccgaagtgctgggattacaggcgtgagccactgtgcctggcctcagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaa

SEQ ID NO: 140876 - DNA, 3334 bp, Homo sapiens
  Payload ID: 7634
  Gene Symbol: HARS
  Gene Name: histidyl-tRNA synthetase
  Uniprot ID: P12081
  ENST ID: ENST00000504156
  CDS Start-End: 721-2250
cccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaagcccgggcggcgcacgtgcagtggatacctccacccccctgggaggcggggtcgcgctcagagccaatgagagcttgcggggtggaggggtagggaagcttccagaggccggtggggaggaagttataaagagggtacgagggggccagctggagagccatgcagtccaagcgggattgtgaggtaagcggctggcgacttgggggccggcgagccccgccggagcgggggtcggctttagggaccccagtaccacaggagaggtgggggcgcgcttggcgatccgccattccaaccttcctttccctctcagctgtggtgtgagagggtgaatccagagaacaaggcggcgctggaggcgtgggtcagggagacaggcatccgcctggtgcaggtgaacgggcagaggaagtatggcgggccacccccaggtacggtagtcccagcccctccgcctgtccggctacaccagccccctttgggggaggggctgctccgagccttcactgtcagaaactgcgaactaccc

SEQ ID NO: 140877 - DNA, 950 bp, Homo sapiens
  Payload ID: 7634
  Gene Symbol: HARS
  Gene Name: histidyl-tRNA synthetase
  ENST ID: ENST00000507746
  CDS Start-End: 86-950
gactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagagg

SEQ ID NO: 140878 - DNA, 3494 bp, Homo sapiens
  Payload ID: 7634
  Gene Symbol: HARS
  Gene Name: histidyl-tRNA synthetase
  ENST ID: ENST00000504366
  CDS Start-End: 1821-3143
ttgaaactctgtacccattaaacaataactccccacttcaccctccctccagcccctggtaactgctatcctactttctactttctgtctctatggatttgactattctaggtactagataagtgagagactaattgttctttttttttttttttaagttcattgatctagctttcaaattccacattgcaaccaatctttaagaaacaaccacttgttggattctgatgtagtaccaaagaaaaatatccacagttagctgaaaagtttgttaaaatactcttccttttacaactacatatctgtgtaaggttagattttcgttatatacttcaaccagcacgacatatcacgacagattgaatgcaaaaatcacatatgagaatcctgctgtcttctattcagtcagacattaaagatttgcaaagatgtaaatcagtgccactcttctcactaaattgttttggaaaacagttacctttttctaaaatattatttgcgttaacatataatagatatattatttgtgttaacatatgttatttgttaaatgaataaatattttaaaatttttgccgttctaattctaatacagtaaatattgataggtataatccactttggggtcttgaatacatagtaagagtgtaaagaggtcctgaaaccaaagactttggagtagggtataaaagcccagattggaagctctgacctggaaggacaacacagttctagtcctgactgccacgaacatgctgaatggccttaagaaatgacttaacttctcaacatcctgtacttcatctgtaaaatttatctgcctagcctatgtcatagagttgttaccagaaacaaattagagaacaaacagttgtaactaagatttaaaagaaaagttatattgggagagaaacgttgcttataaaatttggaattcaattagttgagccagtttgagttggttatattgcctataatcatgtaggtatttttttgttgttattatttttgtttgtttggttgggtttgtttttgtttttgtttttgttttgacagagtcttgctctgtctcccaggctggagtgcagtggcactatctcagctcactgcaagctccacctgccgggttcacgccattctcctgcctcagcctcccaagtagctgggactacaggcacctgccaccacgcccggctaatttttttgtatttttagtagagacggggtttcacagtgttcgccaggatggtcttgatctcctgacttcgtgatccgcccgcctcggcctccccaagtgctggcattacaggtgtgagccaccgcgcccggctggttggtttgttttgtttttgagacagagtctcgctctgtctctcagtctggagtgcagtggtgcaatcttggctcactgcaacctccgcctcccaggttcaagtgattctccctgccttgagcctcctgagtagctgggattacaggcacctgccaccaccatttgtttgttttattgagacagtctcactctgttgcccaggctggagtgcagtggcacaatctcggctcactgcaacctccacctcccaggttcaaggatcctcatgcatcagcctcccaagtagctgggactacaaggggcgtgtcgtcgcacccggctaatttctgtatttttagtagagacgaggtttcaccatgttggccaggctggtctcgaacccctgacctcaggcaatccatctgccttggcctcccgaagtgctgggattacaggcgtgagccactgtgcctggcctcagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgg

SEQ ID NO: 140879 - DNA, 2483 bp, Homo sapiens
  Payload ID: 7635
  Gene Symbol: HARS2
  Gene Name: histidyl-tRNA synthetase 2, mitochondrial
  Uniprot ID: P49590
  ENST ID: ENST00000230771
  CDS Start-End: 224-1744
aaaaattatttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaata

SEQ ID NO: 140880 - DNA, 1426 bp, Homo sapiens
  Payload ID: 7635
  Gene Symbol: HARS2
  Gene Name: histidyl-tRNA synthetase 2, mitochondrial
  ENST ID: ENST00000448069
  CDS Start-End: 36-1040
gttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggattttgacattgctggtcagtttgaccctatgatccccgatgcagagtgtttgaagatcatgtgtgaaatcctaagtggattgcagttgggagactttctcattaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctac

SEQ ID NO: 140881 - DNA, 1450 bp, Homo sapiens
  Payload ID: 7635
  Gene Symbol: HARS2
  Gene Name: histidyl-tRNA synthetase 2, mitochondrial
  ENST ID: ENST00000510104
  CDS Start-End: 219-518
ttatttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtgaggccagggctgagaactgtgggagaagtctggatttggcctaatactgtttatgcaagtcccaaacttgggtgactccaacccttaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttgctgtctgtggtgttcctgaaagcaagttccgtgccatctgctcctccatagataaactagacaaggtaacaaagaagacatacttcagtagaccctatctagcttctgccctgccctcaaatccataccactagtgaaaaataaggagattgtggctggaagtgggctattttggggtggaaggtaaggaggcatactctgaaggaag

SEQ ID NO: 140882 - DNA, 1562 bp, Homo sapiens
  Payload ID: 7635
  Gene Symbol: HARS2
  Gene Name: histidyl-tRNA synthetase 2, mitochondrial
  Uniprot ID: P49590
  ENST ID: ENST00000508522
  CDS Start-End: 41-1486
cttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtga

SEQ ID NO: 140883 - DNA, 541 bp, Homo sapiens
  Payload ID: 7635
  Gene Symbol: HARS2
  Gene Name: histidyl-tRNA synthetase 2, mitochondrial
  ENST ID: ENST00000503873
  CDS Start-End: 192-541
gaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtgaagagtctttgcaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagagga

SEQ ID NO: 140884 - DNA, 648 bp, Homo sapiens
  Payload ID: 7635
  Gene Symbol: HARS2
  Gene Name: histidyl-tRNA synthetase 2, mitochondrial
  ENST ID: ENST00000509299
  CDS Start-End: 106-648
gtgccgaagctggctactaagggaacttgggaggatcccacctcagccttcgtgactagtgaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtgaagagtctttgcaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgt

SEQ ID NO: 140885 - DNA, 564 bp, Homo sapiens
  Payload ID: 7635
  Gene Symbol: HARS2
  Gene Name: histidyl-tRNA synthetase 2, mitochondrial
  ENST ID: ENST00000520095
  CDS Start-End: 129-428
attatttccggctcctcccggaagtgccgaagctggctactaagggaacttgggaggatcccacctcagccttcgtgactagtgaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggattttgacattgctggtcagtttgaccctatg

SEQ ID NO: 140886 - DNA, 1809 bp, Homo sapiens
  Payload ID: 7636
  Gene Symbol: HM13
  Gene Name: histocompatibility (minor) 13
  Uniprot ID: Q8TCT9
  ENST ID: ENST00000335574
  CDS Start-End: 125-1309
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 140887 - DNA, 847 bp, Homo sapiens
  Payload ID: 7636
  Gene Symbol: HM13
  Gene Name: histocompatibility (minor) 13
  ENST ID: ENST00000344042
  CDS Start-End: 32-847
gctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaaggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcat

SEQ ID NO: 140888 - DNA, 1606 bp, Homo sapiens
  Payload ID: 7636
  Gene Symbol: HM13
  Gene Name: histocompatibility (minor) 13
  Uniprot ID: Q8TCT9
  ENST ID: ENST00000340852
  CDS Start-End: 125-1258
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 140889 - DNA, 3792 bp, Homo sapiens
  Payload ID: 7636
  Gene Symbol: HM13
  Gene Name: histocompatibility (minor) 13
  Uniprot ID: Q8TCT9
  ENST ID: ENST00000398174
  CDS Start-End: 125-1405
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaagattctctgtttaagcacccagtgtcttgccctgggttttctaggtctcacctgcccacccaaaatcttttctgcaagccccttaagggtgcccaccccagtgcctggccagccctgcacccgtaaaacaccttttagccagtagagggggcccacgagccctctctcaccagctagcacttttctcaccaccttcctcgaaatacttgggggcagcaagggtgttggcagatgagagtctcccactcaccatggtgagagtggtggggagtacccagggctgacctgactcacaagggaagcagtaactgtagaacctgccagcctccctggtccctgtgcccatatggcttcggctgatgagggctcagactctaggttgccctgaagatcaaggctttgtctcccattctgcccattcctgggtttcttcccaaaatgactactgtggggccagtcatggcacaagggccaggacctctagaggctggggtggggaaggactgagctagtgattcttagaggccttctggggcctaagagctgaaatctcagcgcccgggtttccctaaagtttgctgaagacagcagccccggccagcaggagaccgaccgggcaccaccccaaaccaggcaaacggtggccacaaccctcatccacccacctggtatgaggtcactgagtggggaaacagacaggagcgggtggccaccatactgacagacccggggctctcccttgcccaagcttcaggttcaaaggctgaaaataacagtggcttccagtttggaagtggccaaaggacaatcatgaccagagactcaggagtatgactgtaataccctcactaggtattgacatgcactaagcaccttgatataggatttcacttccttctgagtcttgggctgtatgtgctattattcgctccgctgtgcagatgagggaattgaggcagcttgcccatggacatcgatttgaccttagccaagccaaacaattccaggttcctaaggaccgcagctcctccccagacccctgggaccaagtcactggctggtgtgctgggcatccctgagccccagccacccaattttactggctccagggttctataggaaggaaaaggggtagaaaatttcaaaaggcttcttcctttcagggaggggggttccctttcaggggcttctggaatctctacccactccagccaactctgaggccatgtggtcctggaacaaggcccctctgaggcagatggggcaggcggcccaggcacatagcatggttggctctgcggcccagggcgcacaaaggccttattgagtcaccaccagcccccggcagaggctgaggtggcagtggcgccgagcgcctgccacctaatgactgtcctggtccagccagatgttccacagacctccggagcagcggactagggcccgcccggccagccggcaccgcagaggccactgtaattccaattaaccagcttcagctgagcaaacagcgggcagtggtggcccagcccaggcggtaggcctggcccgcagagcctgcgagtctagactccagatgtgaaccgccaccatcagagtcccatggaaaaatggcaccaggccgggcaaggattgggcctgcatgctggggagggggtgtgggtggttgggcagggccccgagtgggctagatgccagcctcacctggtttggggtggattattaggaaactgctctagaacccaagttctaccctgctttattagattctgtttctgtgcctcagtctcccatgactgcgacaagagagagggttccaaggggaaaaccagccctgctgagaccccagtgtgcactgactgtatttcacgtgactagcattatgctagtgcaactgacccttgaacaacacagggattaggggcaccaacccatcatggtcgaaaatctgtataacttttcagtcccgcaaaacaactaatagtctgctgttgaccagaagccttacctgataacataaacagtcaaaacatcttgta

SEQ ID NO: 140890 - DNA, 3932 bp, Homo sapiens
  Payload ID: 7636
  Gene Symbol: HM13
  Gene Name: histocompatibility (minor) 13
  ENST ID: ENST00000498035
  CDS Start-End: 96-527
aggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcaggtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagccaggattcaaacccaggtgtggctccagagcccatcctcttcccactgctaccctaactcaaactgccacatgctcgtgtcctttcagtggggagagtggttcattagagggggttgctacttttattttggacaggccagttctccattctgcaggactatcccatgtattacaaacagttggcaaccttgccctgctcaccaaatgggagttgcataccagtattccccagcttgtgactacagagatgtcccagtatgtttctttctgccccgttgaagaggtgcagcctcaggctgagaaacactgatagaccaagaggtggccagggttcccagaaggaaggaactcaccttgaacttagctttctttgaagggtaggaaacctggaagacgtacaaaggagggagaggtcaggtgctagaaagtttgtgcacattgagggcatgggcagaatctgctcccaaaagcattgaaagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctcaaaaaaaaaaaaaaagccaatatgaatgtggcttcattcttctaggcacactggcaggacagtgtggtagtcaggagcacagggtcaagaggcaggcagccttgggacaaacacctggtgctgccagctctaatatgtgtaaattactcaagctctgagcatagttcttctacctataaaatggagagactacaggtacctcctcagaggtgtggggagggtctagtgagccccaggctgtaacatccctagagcacagtgccaagcacacagtgagcctagtggctggcccagggttacacagctgagacttcacctctggtcttcccactgaggtcattgttgtcctcacctgcactgactcttcacccacaaaattctattctagctagcttgggagaattctagtccagccccgcatcctgaaaaatggaggcccagggaacctgagtgacttggacccaaccaagataatggcaggcccagtcgcccttgctcacaggacaaaccagtcctttcgtggtggacctggggtggggtgggggcagtcacttgcagacattgggtgtcctcctttcccatgctgattaggatcctccccaactgtagcccatcctaccccagcatctgtgagacgcttgagacccccaagtctccccacagcccagcctccacctcagagagcccagtgggttttgaaagccactgttaggctgtgtgctgaggaactgattatttaatgttatagcaacaaccctacaatgaagatcttatctctacccagctgcctaggcagggtattttgaacctttatcatcttgacaccaaagactttttttcccttttagaataataactaagggacattgtcccaaatttctcatagatgagtaatctatgtcaagaaataattgagggtgggcacggtggctcacacctgtaatcgcagcactttgtgaggccaaggcaggtggatcacctgaggtcaggagttcaagaccagcctgggcaacatggtgaaaccttgtctactaaaaatacaaaaaagtagccgggtgtgatgacgcacccagctactcgggaggctgaggcaggagaatcacttgaacccaggaggtggaggtcgcaatgagtcaagatcgcaccactgcactccagcctgggtgacagagggagactccatctcaaaaaaaaaaaaaagaaataattgtctatctgtcttttagccacttcataatttttagagatagatattatcaacagaaaataaaaccaacagcagctaaaactgcacatggtaaaatgtatgagtgactagaaactaacagaagaataattttcttaatgaaatttagagcaacaaaatttgacctgggaaaaccataccttttaaaaataatggatcacctgggcatggtggttcacacctgtcatcccagcactttgggaaccctaggctgttggatcacctgagctcaggagttcaagaccagcctgggcaacatgttgagaccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaattaaa

SEQ ID NO: 140891 - DNA, 455 bp, Homo sapiens
  Payload ID: 7636
  Gene Symbol: HM13
  Gene Name: histocompatibility (minor) 13
  ENST ID: ENST00000619859
  CDS Start-End: 1-153
ttcattgccttgctgctgcgctttgacatcagcttgaagaagaatacccacacctacttctacaccagctttgcagcctacatcttcggcctgggccttaccatcttcatcatgcacatcttcaagcatgctcaggttcttggtctacactgacttcaaaaacgaagctgcagaccctcgcagtgaatgttacagttcttaaaggcagcgtgtctggaatttgttccttgtgatgttcggatgtgctgggagttttttccttctggtgggttcgtgatctcactggctcaggaatgaagctgcagaccctcgcggtgagtgttacagttcttaaggcggcgtatccggagttgttcgttcctccccgtgggtttgtggtctcgctggcttcaaaagtgaagctgtagacctttacagcgagtatcacagctcacaaaagcaatgtggaaccaaac

SEQ ID NO: 140892 - DNA, 4273 bp, Homo sapiens
  Payload ID: 7637
  Gene Symbol: HMHA1
  Gene Name: histocompatibility (minor) HA-1
  Uniprot ID: Q92619
  ENST ID: ENST00000313093
  CDS Start-End: 241-3651
cactccgcagagccgcaggctgaggccgggaagggtcgggggcgaggccgcgtcgccgcctccccgaagccttttcctgttggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140893 - DNA, 3750 bp, Homo sapiens
  Payload ID: 7637
  Gene Symbol: HMHA1
  Gene Name: histocompatibility (minor) HA-1
  ENST ID: ENST00000543365
  CDS Start-End: 69-3128
cggagacccccatcggtcagctgccaggccccacgcgctcgcggtctccgcgccccgacggctgcgccatgtgtatctgcgggacggcgcacccggtgctggacgagggccccgtgcgctgccgggcgggcccccgagacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140894 - DNA, 4184 bp, Homo sapiens
  Payload ID: 7637
  Gene Symbol: HMHA1
  Gene Name: histocompatibility (minor) HA-1
  Uniprot ID: Q92619
  ENST ID: ENST00000539243
  CDS Start-End: 104-3562
aagcttacaggagcccggtgtcccggagcacaggccagggccgggccagaagcccatccgacatccagctgaccctcaccctctgaccccagccctcagcgccatgagtcgggggcaaagagttctcaagggtctgctgggctgggtttgcacttggacctgggcctggagagccagacttggagcaaggggctgtggccttcatgtcctgtgccccagagatctgcccctcccacccgaggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140895 - DNA, 3875 bp, Homo sapiens
  Payload ID: 7637
  Gene Symbol: HMHA1
  Gene Name: histocompatibility (minor) HA-1
  ENST ID: ENST00000587602
  CDS Start-End: 90-272
gacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcggggacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacaggggtgagtgtccggcggggcccaggggcggacgctggctccctgcgacccaccctggcccttcaccagagacgcctctttctccagccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140896 - DNA, 4191 bp, Homo sapiens
  Payload ID: 7637
  Gene Symbol: HMHA1
  Gene Name: histocompatibility (minor) HA-1
  ENST ID: ENST00000590214
  CDS Start-End: 80-3571
tcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcggggccccacttcatttctggggaaactgaggccgtgtccaggccggaaaatccctttaacgagctcccctcggacctgcccaaggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcg

SEQ ID NO: 140897 - DNA, 539 bp, Homo sapiens
  Payload ID: 7637
  Gene Symbol: HMHA1
  Gene Name: histocompatibility (minor) HA-1
  ENST ID: ENST00000587186
  CDS Start-End: 29-539
aaccaggtgtcctcagcatattctgccgatggtggggtccacaccacactttggggacccctgtgcaggcagcccaggaccaggtggacgtggggacccagacggacgtggggacccagacggacagggcccggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatct

SEQ ID NO: 140898 - DNA, 3218 bp, Homo sapiens
  Payload ID: 7637
  Gene Symbol: HMHA1
  Gene Name: histocompatibility (minor) HA-1
  ENST ID: ENST00000590577
  CDS Start-End: 281-2596
gattctagtgcctcagcctcccgagtagctgggattacaagcgtgcaccacaatgcccggctaattgttttaaattttgggtagatacggggtttcactatgttggccaggctggtctcaaactcctgacctcaagtgatccacctgcctcggcctcccaaagtgctgggattacagacgtgagccaccgcgcccggccactcctcctgtttttccgctgccgattgttgtgcagggtcctctgcatgcccagctgggccatggggccttgctgagagagatgggggtggggaggaaaggaggagctggggagactgagtcccatccgaggatagggttggaactggcctcctggctcccacacccacagcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140899 - DNA, 4120 bp, Homo sapiens
  Payload ID: 7637
  Gene Symbol: HMHA1
  Gene Name: histocompatibility (minor) HA-1
  ENST ID: ENST00000586866
  CDS Start-End: 76-3498
gagtggagcccgggtgagacccggagctgacgccgggccgcagggggacagggacccgccctgtgctcggggctcatgctggggcggcggctgggggctcgtgccagctacagcccctaccgggcgggacggcaggggccacagcagagaggccgggaccccggcattcagctcacggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140900 - DNA, 1284 bp, Homo sapiens
  Payload ID: 7637
  Gene Symbol: HMHA1
  Gene Name: histocompatibility (minor) HA-1
  ENST ID: ENST00000591169
  CDS Start-End: 1-237
ggccggcaggacggctcggagagcgaggcagtggcggtggccctggcaggtcggctgcgggagctcctgcgggacctgccgcctgagaaccgggcctcgctgcagtacctgctgcgtcacctacgcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 140901 - DNA, 384 bp, Homo sapiens
  Payload ID: 7638
  Gene Symbol: HMHB1
  Gene Name: histocompatibility (minor) HB-1
  Uniprot ID: O97980
  ENST ID: ENST00000289448
  CDS Start-End: 108-233
ccacatcccaggaggccgaggcggcttgccccgcatctcagaagccgggcaggccctgagccttctgacctcacatcctctgccacaccacagtggagaaaccagaactggaggagcagccagaatgcagagaagaaaaaagaggttctctgcatgtttggaagtcggaattggttgaagttgaagatgatgtgtatctgaggcacagctcttccctgacttataggctttgacactgctgttgaggtttgactcgaagcccagagttttggtgtggatgagcagggacaaattgctgagcatgaagaagagtaaaattaagcaagtggaacatatgccctttgcctctgctctgcacagtgaaatgaaaagtcaacctttgaa

SEQ ID NO: 140902 - DNA, 2101 bp, Homo sapiens
  Payload ID: 7639
  Gene Symbol: HMSD
  Gene Name: histocompatibility (minor) serpin domain containing
  Uniprot ID: A8MTL9
  ENST ID: ENST00000408945
  CDS Start-End: 203-622
attcactgggaactaacacccggcgccgctcagacatctctattcccgcctctccgacccggtctcacttcgctcctgggcagctgcgcggagaactggggctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaaggtgaaaatatattgttattctatttcgataatattttaaacagttttatagtcagttctttacaaaactgtcaaatataaaaaggagtccttttttctctaaacaactatgcaaacattaaaacctttctttggaaatattgccaactcgtagaccttttctctagctttagcttttcccttatcaagtatctgtgatgtctctctagatgaaataatctcttccaggtttttttgcttgttaatattaggtagtttttcttttcacaaatagcgttaaaatttgaatttaaaaatttctagctgtctccctcactggtattgccatactgtatggtttacaggcttgaaatgcaactgctgtgatcagtgataagggaacacactgatgatttagattgaacagggagagttatattgttttctagggcacagctaaaaagacattccatcaacccccttgcagccagaaagaccctgagccctcagaacttcactgacacaacccatattttctttccataactggccaacttttccctttgtaccaaagccagctacttagcttcagggagagaatgagactgaagattacaaggagacatccacattatatgtgggctgagagaggaaagagggagtatcagaggttgccgggtttgctactctcattcctcttcctcctctgcccaacacttggacttggaaagaagtctgaaaggtggggaataatcagcccatatgattcttccactgcagagagagcctctgagtgttacagccaggagcaacagggtggcaccctcttcttcagggaaacacacacctctttgcactgccttgtggatagtccagtcaagtggagtaagaggtgggagtggggagtgtaaatggagtaacctctaagtatccaagcaggagggtgttttttttttttctttcctggaatgaggataatcaaatcatttcaatatgaattatgaaaatgaatgataatggttttatctgttatagaaatataatataatcagactttagccatgtaaatcataaaacatagagataacaatatgcatattgttcctagagggtcttgtgaaattttgtttgtcatattctctttgaagagttatcattcactattttatttctgtcttgtaaagcctgaaagctcatgtgctgccttgacatctatgggcttctcagggcctcagaggcctggccatgaagtcccctgctcttgtcagatatgtgcaccctattcacccactgagcaggaaggctcttcccccttctaagttcccttaccaggcagtcagctgtaccctccctgggtctcaacgtggctcacttccctccagcctggaaaattattcaaacaagcctgtcacatctggaggagccaggaatcgcctcttcctcttgttactgcaaagcctgccttccacagcccctactggttcactctattcccaaatgcaactctcctgtgaccccgcatggcatgtggtgacctccctccctgtgagcagttgtgactaataaactgccgccaatttc

SEQ ID NO: 140903 - DNA, 162 bp, Homo sapiens
  Payload ID: 7639
  Gene Symbol: HMSD
  Gene Name: histocompatibility (minor) serpin domain containing
  Uniprot ID: P0C7T4
  ENST ID: ENST00000526932
  CDS Start-End: 1-162
atggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataa

SEQ ID NO: 140904 - DNA, 1626 bp, Homo sapiens
  Payload ID: 7640
  Gene Symbol: HAT1
  Gene Name: histone acetyltransferase 1
  Uniprot ID: O14929
  ENST ID: ENST00000264108
  CDS Start-End: 37-1296
cgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggtgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaata

SEQ ID NO: 140905 - DNA, 1642 bp, Homo sapiens
  Payload ID: 7640
  Gene Symbol: HAT1
  Gene Name: histone acetyltransferase 1
  ENST ID: ENST00000457761
  CDS Start-End: 40-417
attcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgagcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggtgatagaggcacaacagaagttcaaaataaataagcaacacgctagaagggtttatgaaattcttcgactactggtaactgacatgagtgatgccgaacaatacagaagctacagactggatattaaaagaagactaattagcccatataaggtaggactttcaagaatcttaaacactgtattcttttcactgtttaaaacagaagaaaagctaccaaatatcagtatatgagagagtccaagtcattttgtaaaattaacttttacaaaagtagaaatattcttccagtaatttataaaaattctcactcatggccgggcgtggtggcccacacctgtaatcccagcactcagggaggccaaggcgggtggatcacctcaggtcagaagttcaagaccagcctggccaacgtggtgaaaccctgtctctactaaaaatacaaacattagctaggcttggtggtgggcgcctgtaatacagtgacttgggaggctgaagcaggagaatcgcttgaatccaggaggtggaggttgctgtgagccaagattgcaccattgcactccagcctgggtgacaagagcaaaactccatctgaaaagaaaagaaaagaaaagaaaaaaaacccgggtgcagtggctcacgcctgtaatcccagcactgtgggaggccgaggtaggtggatcacttgaggtcaggagttcaagaccaccctggccaacatggcgaaaccccatctctactaaaaatacaaaaattagctgggcatgataacacgtgcctgt

SEQ ID NO: 140906 - DNA, 1567 bp, Homo sapiens
  Payload ID: 7640
  Gene Symbol: HAT1
  Gene Name: histone acetyltransferase 1
  ENST ID: ENST00000412731
  CDS Start-End: 54-194
gagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagtgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggtgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaata

SEQ ID NO: 140907 - DNA, 4053 bp, Homo sapiens
  Payload ID: 7641
  Gene Symbol: HIRA
  Gene Name: histone cell cycle regulator
  Uniprot ID: P54198
  ENST ID: ENST00000263208
  CDS Start-End: 258-3311
gttgcccgggagccgcctgaggaggagcggcgcaggggatgcggctgtggtggcggcggcggcggccgagcgcgggtggcggctgtggcggcggaggggggcgcgggccggcgatggcgcggcggccctgagggcgcggggcgggcggcggccggagggcgggtggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaa

SEQ ID NO: 140908 - DNA, 3395 bp, Homo sapiens
  Payload ID: 7641
  Gene Symbol: HIRA
  Gene Name: histone cell cycle regulator
  Uniprot ID: P54198
  ENST ID: ENST00000340170
  CDS Start-End: 221-2653
gatgcggctgtggtggcggcggcggcggccgagcgcgggtggcggctgtggcggcggaggggggcgcgggccggcgatggcgcggcggccctgagggcgcggggcgggcggcggccggagggcgggtggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaagggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaa

SEQ ID NO: 140909 - DNA, 453 bp, Homo sapiens
  Payload ID: 7641
  Gene Symbol: HIRA
  Gene Name: histone cell cycle regulator
  ENST ID: ENST00000452818
  CDS Start-End: 1-160
ggcctgcgaacagtggcagcgcgacctggccagctgccgcgactgggaggagcgccggaacgccgaggcccaggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatgg

SEQ ID NO: 140910 - DNA, 648 bp, Homo sapiens
  Payload ID: 7642
  Gene Symbol: HIST1H1A
  Gene Name: histone cluster 1, H1a
  Uniprot ID: Q02539
  ENST ID: ENST00000244573
  CDS Start-End: 1-648
atgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaa

SEQ ID NO: 140911 - DNA, 681 bp, Homo sapiens
  Payload ID: 7643
  Gene Symbol: HIST1H1B
  Gene Name: histone cluster 1, H1b
  Uniprot ID: P16401
  ENST ID: ENST00000331442
  CDS Start-End: 1-681
atgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtag

SEQ ID NO: 140912 - DNA, 642 bp, Homo sapiens
  Payload ID: 7644
  Gene Symbol: HIST1H1C
  Gene Name: histone cluster 1, H1c
  Uniprot ID: P16403
  ENST ID: ENST00000343677
  CDS Start-End: 1-642
atgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaatag

SEQ ID NO: 140913 - DNA, 666 bp, Homo sapiens
  Payload ID: 7645
  Gene Symbol: HIST1H1D
  Gene Name: histone cluster 1, H1d
  Uniprot ID: P16402
  ENST ID: ENST00000244534
  CDS Start-End: 1-666
atgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggcggccaagcctaagtcggggaagccgaaggttacaaaggcaaagaaggcagctccgaagaaaaagtga

SEQ ID NO: 140914 - DNA, 754 bp, Homo sapiens
  Payload ID: 7646
  Gene Symbol: HIST1H1E
  Gene Name: histone cluster 1, H1e
  Uniprot ID: P10412
  ENST ID: ENST00000304218
  CDS Start-End: 38-697
ccggctcgaattgctctcgctcacgcttgccttcaacatgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaagaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtagaaagttcctttggccaactgcttagaagcccaacacaacccaaaggctcttttcaga

SEQ ID NO: 140915 - DNA, 718 bp, Homo sapiens
  Payload ID: 7647
  Gene Symbol: HIST1H1T
  Gene Name: histone cluster 1, H1t
  Uniprot ID: P22492
  ENST ID: ENST00000338379
  CDS Start-End: 44-667
catgcttttcgctggttattacatcttgcgtttctctgttgttatgtctgaaaccgtgcctgcagcttctgccagtgctggtgtagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaagtcagtttctgccaagaccaagaagctggttttatccagggactccaagtcaccaaagactgctaaaaccaataagagagccaagaagccgagagcgacaactcctaaaactgttaggagcgggagaaaggctaaaggagccaagggtaagcaacagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagag

SEQ ID NO: 140916 - DNA, 396 bp, Homo sapiens
  Payload ID: 7648
  Gene Symbol: HIST1H2AA
  Gene Name: histone cluster 1, H2aa
  Uniprot ID: Q96QV6
  ENST ID: ENST00000297012
  CDS Start-End: 1-396
atgtctggacgagggaagcagggaggaaaagcacgcgccaagtctaagtctcgctcttctagagcgggtttgcagtttcccgtaggccggatccatcgtctgcttcgtaagggaaactatgcagagcggataggggcaggcgcaccagtgtatttggcggcagtgttagagtatctcacagcagaaatccttgagctggcaggcaatgcgtctcgcgataacaaaaaaactcgcattattccccgccacctgcagctagcgatccgcaatgatgaggaactcaataagcttttgggcggcgtgaccattgcccagggcggagtcctgcctaacattcaggcagtgctgctgcccaagaagactgagagtcaccaccataaagcccaaagcaagtaa

SEQ ID NO: 140917 - DNA, 393 bp, Homo sapiens
  Payload ID: 7649
  Gene Symbol: HIST1H2AB
  Gene Name: histone cluster 1, H2ab
  Uniprot ID: P04908
  ENST ID: ENST00000615868
  CDS Start-End: 1-393
atgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaactcttggggcgtgtgaccatcgcgcagggtggcgttttgcctaatattcaggcggtgctgctgcctaagaaaactgagagccatcataaggccaagggaaagtga

SEQ ID NO: 140918 - DNA, 1668 bp, Homo sapiens
  Payload ID: 7650
  Gene Symbol: HIST1H2AC
  Gene Name: histone cluster 1, H2ac
  Uniprot ID: Q93077
  ENST ID: ENST00000314088
  CDS Start-End: 89-481
aaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaagggagaggaaa

SEQ ID NO: 140919 - DNA, 1654 bp, Homo sapiens
  Payload ID: 7650
  Gene Symbol: HIST1H2AC
  Gene Name: histone cluster 1, H2ac
  Uniprot ID: Q93077
  ENST ID: ENST00000377791
  CDS Start-End: 89-481
aaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgc

SEQ ID NO: 140920 - DNA, 1462 bp, Homo sapiens
  Payload ID: 7650
  Gene Symbol: HIST1H2AC
  Gene Name: histone cluster 1, H2ac
  Uniprot ID: Q93077
  ENST ID: ENST00000602637
  CDS Start-End: 31-423
gctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatga

SEQ ID NO: 140921 - DNA, 393 bp, Homo sapiens
  Payload ID: 7651
  Gene Symbol: HIST1H2AD
  Gene Name: histone cluster 1, H2ad
  Uniprot ID: P20671
  ENST ID: ENST00000341023
  CDS Start-End: 1-393
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaa

SEQ ID NO: 140922 - DNA, 509 bp, Homo sapiens
  Payload ID: 7652
  Gene Symbol: HIST1H2AE
  Gene Name: histone cluster 1, H2ae
  Uniprot ID: P04908
  ENST ID: ENST00000303910
  CDS Start-End: 1-393
atgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctc

SEQ ID NO: 140923 - DNA, 2250 bp, Homo sapiens
  Payload ID: 7653
  Gene Symbol: HIST1H2AG
  Gene Name: histone cluster 1, H2ag
  Uniprot ID: P0C0S8
  ENST ID: ENST00000359193
  CDS Start-End: 31-423
tgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcgggcaacgcggcccgcgacaacaagaagacccgcatcatcccgcgtcatctccaactggccatccgcaacgacgaggagctcaacaagctgctgggcaaagtcaccatcgcacagggcggtgtcctgcccaacattcaggccgtgctactgcccaaaaagactgagagccaccacaaggcgaagggcaagtaactatctgtactagtttgtggcagctcaagtaaaatcgagtccaaaccaacggctcttttcagggccacccacgtcttctctaaaagaacttaacatttattccatgtgaaagaaagtgagacatggacaagactctagtcataaattacccatctttttgaaaacagtgtagcgaacaccgcagatttaaaagaaaaactagagggaaggtggtccagattttaccacgcttaaaagttaagatgtgaacaaatctcttaggccattacttaattttaaacttaatcagtgtgtgtccacagagcaccagtggcttcgtgagttcttgaagcactttggcccaaaagagttatcgcccgggctagaatttagcagacagctgttccacgcgggccagggcggcatgaagaagtcccgccgctacgtgcccggcacagtggccctgcgcgacgttcggcgctaccagaactccgagctgctgatcagcaagctgccgctcctgcgagagctcggcggtgacgccgctgcacgagagcgaggctgaagaactttgtgacacaatagtccacctccctgcaaaggctctgtcagagactcacatctttcctgatggatagctgtgaagcattctcttacccaccctactgcatgttgcaaagtattcctttaaaatgaagtgagtaaaatactgggatgacgttatctggagcccaagaaagatggctcatttggaaaggcctaatatcccaagttgcttacctagaagaacttgacaggatagttaataataaaccttaaaacccatgaagaaatctgaggtaaagtgttagcacacagactgttaaaatgtctgcctcacagataggagggaaaatatatagaggattataatatggttcaacaaatgttgatgagtattagaaatgtacattagaaatattagaaatgtttatgactattagaaaagtacagggtattgggcgttcctgacacaaactgaggcctcctagcaagactggcagttttctgtaaaggagggttatttactacggtagtgcaaataacttttggtgttgtagctaaataaggaatactcatgccaagattgcacaattgtgcctcctccctctgttcactgaactctgatgtaattttttttttttttttgagacggagtctcgctctgtcgcccaggctggagtgcagtggcgctatctcggctcactgcaagctccgcctcccgggttcacgccattctcctgcctcagcctcctgagtagctggggctacaggcgtctgccaccatgcccagctacttttttgtatttttagtagatacggggtttcaccgtgttagccaggatggtcttgatgtcctgacctcgtgatccaccggcctcggcctcccaaagtgctgggattaccggcgtaagccaccacgcccggcccactctgaagtaatcttaagaagacgttaactcatttttcttgtgtattgtagacacttttggctgtctggtaacatggaaaatctcagaatgatgttttaagtatataaaatgccaaacaaagttaaattacagttatcaaagtatttttaaaacttcatagtgataaatgagactatatagttatattgttaatatagttaacacattacatgatttggtgagcctaattgctgttactaattagaggagtaaaaatgtttcacgataactcagcaattgtaatgagaaatgaaacatctaatgtcttttgggttacaaagtaacaggtactgagatttgtggcctaaattcataataaagtgaaatgttcaagttc

SEQ ID NO: 140924 - DNA, 387 bp, Homo sapiens
  Payload ID: 7654
  Gene Symbol: HIST1H2AH
  Gene Name: histone cluster 1, H2ah
  Uniprot ID: Q96KK5
  ENST ID: ENST00000377459
  CDS Start-End: 1-387
atgtctggacgtggcaagcaaggcggtaaagctcgcgccaaggccaagacccgctcttctcgggctgggcttcagttccccgtgggccgagtgcaccgcctgctccgcaagggtaattatgccgagcgggttggagccggcgcgccagtgtacctggctgcggtgctggagtacctgaccgctgagatcctggagctggctggcaatgcggcccgcgacaacaagaagacccgtatcatcccgcgtcacctccaactggccatccgcaacgacgaggagctcaacaagctgctgggcaaagtcaccatcgcgcagggtggtgtcttgcccaatatccaggccgtgctgctgcctaagaagactgagagccaccataaggccaaataa

SEQ ID NO: 140925 - DNA, 503 bp, Homo sapiens
  Payload ID: 7655
  Gene Symbol: HIST1H2AI
  Gene Name: histone cluster 1, H2ai
  Uniprot ID: P0C0S8
  ENST ID: ENST00000358739
  CDS Start-End: 12-404
ggccttttgccatgtctgggcgtggcaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctactgcccaagaagaccgagagccaccacaaggcgaagggcaagtagaagcctggattagtttgcagcaactcaatcccaaaggaaccaaaggctcttttcagagccacctacaattttgtggaagaactgagcactatgtttaat

SEQ ID NO: 140926 - DNA, 387 bp, Homo sapiens
  Payload ID: 7656
  Gene Symbol: HIST1H2AJ
  Gene Name: histone cluster 1, H2aj
  Uniprot ID: Q99878
  ENST ID: ENST00000333151
  CDS Start-End: 1-387
atgtctgggcgtggtaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctgctgccaaagaaaactgagagccaccacaagactaagtaa

SEQ ID NO: 140927 - DNA, 393 bp, Homo sapiens
  Payload ID: 7657
  Gene Symbol: HIST1H2AK
  Gene Name: histone cluster 1, H2ak
  Uniprot ID: P0C0S8
  ENST ID: ENST00000618958
  CDS Start-End: 1-393
atgtcgggacgtggcaagcagggcggcaaagctcgcgccaaggctaagacccgttcttcaagggcgggtcttcagttcccagtgggccgagtgcaccgactgctccgcaagggcaactacgctgagcgggtcggtgccggagcgccggtgtacctggcggcggtgttggagtacctaaccgccgagatcctggaactggctggcaacgcggcccgcgacaacaagaagacccgcatcatcccgcgccacttgcagctggccatccgcaacgacgaggagctcaacaagctgcttggtaaagtgaccatcgcccagggtggtgtcctgcccaatatccaggccgtgctgctgcctaagaaaactgagagccaccacaaggccaagggcaagtag

SEQ ID NO: 140928 - DNA, 393 bp, Homo sapiens
  Payload ID: 7658
  Gene Symbol: HIST1H2AL
  Gene Name: histone cluster 1, H2al
  Uniprot ID: P0C0S8
  ENST ID: ENST00000613174
  CDS Start-End: 1-393
atgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataa

SEQ ID NO: 140929 - DNA, 393 bp, Homo sapiens
  Payload ID: 7659
  Gene Symbol: HIST1H2AM
  Gene Name: histone cluster 1, H2am
  Uniprot ID: P0C0S8
  ENST ID: ENST00000359611
  CDS Start-End: 1-393
atgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaa

SEQ ID NO: 140930 - DNA, 384 bp, Homo sapiens
  Payload ID: 7660
  Gene Symbol: HIST1H2BA
  Gene Name: histone cluster 1, H2ba
  Uniprot ID: Q96A08
  ENST ID: ENST00000274764
  CDS Start-End: 1-384
atgccggaggtgtcatctaaaggtgctaccatttccaagaagggctttaagaaagctgtcgttaagacccagaaaaaggaaggcaaaaagcgcaagaggacccgtaaggagagttattctatttacatctacaaagtgctaaagcaggtccatccggacactggcatctcttcgaaagctatgagcattatgaattccttcgtcactgatatctttgagcgtatagcgagcgaggcatcacgtttggctcactacagcaagcgctccaccatttcttccagagagattcagacagcagtgcgcttgctactgccgggagagctggctaaacatgctgtgtctgagggcaccaaggctgtcactaagtacaccagctccaagtaa

SEQ ID NO: 140931 - DNA, 381 bp, Homo sapiens
  Payload ID: 7661
  Gene Symbol: HIST1H2BB
  Gene Name: histone cluster 1, H2bb
  Uniprot ID: P33778
  ENST ID: ENST00000615966
  CDS Start-End: 1-381
atgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataa

SEQ ID NO: 140932 - DNA, 431 bp, Homo sapiens
  Payload ID: 7661
  Gene Symbol: HIST1H2BB
  Gene Name: histone cluster 1, H2bb
  ENST ID: ENST00000629531
  CDS Start-End: 1-381
atgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataagtgcttatgtaagcacttccaaacccaaaggctcttttcagagccaccta

SEQ ID NO: 140933 - DNA, 659 bp, Homo sapiens
  Payload ID: 7662
  Gene Symbol: HIST1H2BC
  Gene Name: histone cluster 1, H2bc
  Uniprot ID: P62807
  ENST ID: ENST00000314332
  CDS Start-End: 7-387
tttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaaggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctc

SEQ ID NO: 140934 - DNA, 571 bp, Homo sapiens
  Payload ID: 7662
  Gene Symbol: HIST1H2BC
  Gene Name: histone cluster 1, H2bc
  Uniprot ID: P62807
  ENST ID: ENST00000396984
  CDS Start-End: 23-403
gacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatataggaactggagaggggtggggacaagtgttgcagcttagagagg

SEQ ID NO: 140935 - DNA, 789 bp, Homo sapiens
  Payload ID: 7663
  Gene Symbol: HIST1H2BD
  Gene Name: histone cluster 1, H2bd
  Uniprot ID: P58876
  ENST ID: ENST00000289316
  CDS Start-End: 25-405
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaa

SEQ ID NO: 140936 - DNA, 496 bp, Homo sapiens
  Payload ID: 7663
  Gene Symbol: HIST1H2BD
  Gene Name: histone cluster 1, H2bd
  Uniprot ID: P58876
  ENST ID: ENST00000377777
  CDS Start-End: 25-405
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattc

SEQ ID NO: 140937 - DNA, 497 bp, Homo sapiens
  Payload ID: 7664
  Gene Symbol: HIST1H2BE
  Gene Name: histone cluster 1, H2be
  Uniprot ID: P62807
  ENST ID: ENST00000614097
  CDS Start-End: 67-447
caaattccgaggatcaggagatgtagatttcattttctttcctaactgcagaacagcaaagatagcatgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagcca

SEQ ID NO: 140938 - DNA, 2585 bp, Homo sapiens
  Payload ID: 7664
  Gene Symbol: HIST1H2BE
  Gene Name: histone cluster 1, H2be
  ENST ID: ENST00000634910
  CDS Start-End: 1726-2106
gtccgggaggttgcccgtaggccgctaactggtggttcccagtccccgccgactcggcctctttcttctgcggccaccagatcgcgggatatcggagacttcgaacaatccgctggagtcctttacagtttaaaaacagaggaccggccgggcgcggtggctcacgcctgtaatcccagcactttgggaggccgaggcgggcggatcacgagttcaggagatagagaccatcctggctaacaccgtgagaccccgtccctatcaaaagtacaaaaaaattagccgggtgtggtggcacgcgcctgtagtcccagctactcaggaggctgaggcagaagaatcgctagaaccagggaggcggaggttgcagtgaccgagatcgcgccgctgcactccagcctaggcgacagagcgagactgcgtctcaaaacaaaaaaaacggaggatcgaaaattttgaagactgagagcaaggcaacaatcttcccttgacctttttgctcctctcacaagggtttttcagacggctgaaaccaacgaaaagagtgaggaagcaggcagaaaatttcagctttagtctctcagcatcctcctgctttcttctcggggagctggcacttcccccttctctagtagctgtaaatacgcctcccaactccaaggagacctttcttgcatctcccttactgttctcacgcctgtagggctcttcgtgtgaggattcagtgtattttttattttgagatggaatctcactctgtctcccaggctggagtgcagtgccctgatctaagctcattacaacctctacctcccaggttcaagcgattcttctgcctcactttcccaagtaacagggactacagttgcagattgtatcactggactcctctccctctggttttctttgtgtatgttcattttgtgtctctccaacgtattagttcatcctctttaggtgaatttctttctttttatcctactcttcacgtctgtctctctttccattgtgtctgtttcttttttctctccctctgccacttttcccttaatacggtttaaattttctctcatttgtctttctcctttttctctactgactagatataccatcagaggttttttttttcatttctaacaacctcttatagtcattaaagaaatgcttcattttccattcttttaacataagaagaacaagaagcatttttctctttttgcaacacagcccaccaagtgggaaacactgttctccggattgtgtgggtgatcgccggtcgcctagcttgccgttcttcaggtatctcctgctgctccagaatctacatctgaatgtcaaggcatagcttttccaggagcttttaaaccgacctttcaattcgaagacgtaactgcgccaggagctttgtctccctggcatataaaagcatagaagagagcaacttctggtttttaaaataagtaaactaatctgaattgtttgcaatggtaggaacttgttatataaaatgttaattaggtggcccgtgctcgaaaactgctctcaggatatgaccaatgggagagtagacctaagctccttcatttgcatgcagacttcacgacaaaataacgaatcagagttggagaaactaaatcttcatttacataacattgtctacaaattccgaggatcaggagatgtagatttcattttctttcctaactgcagaacagcaaagatagcatgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagccactcaccttttcacaattggagctatatactgacatgtgaagatactagaaactcctgcagctgaaataggcatgtttttaaaacttaaaatggcactcactgtctgggctggtggctttatgaaactctggtttccgtgttttatgaggtatcactcgatagtacctaagaggcaatagtaatttcatagttttgctctacgaagagaaacttcgtttctcaagagtccttaaaaatacgggttttaccaaagaagcccatattatggggggctggagcgggggtggggaaggaggagaggagactgctgctttcaagtagttcttaatgttgaatttgcttttttcctttcctcaattacttcaaaaaggtcttaatttggatttttattttaggttctaaaggaaaaaataaaaccctcttccctct

SEQ ID NO: 140939 - DNA, 1196 bp, Homo sapiens
  Payload ID: 7665
  Gene Symbol: HIST1H2BF
  Gene Name: histone cluster 1, H2bf
  Uniprot ID: P62807
  ENST ID: ENST00000356530
  CDS Start-End: 40-420
gcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttaccccaagtgctggttagaaggctagcccattgtgctgataagcacatttttcttatgttgtgctgtgatgtgtcccttgtcaaattggtttcataagaaaagaacttttgaaatatctcttttgctactgacatagtgtgagggaaaggaatgtcttccttaattccggtttagtcatcgcagcattggcgaatttagctggttaaaataatgtaatcaaattctttaaaatataaggaaagcaagacaagtaatgtgcatgaaaactgaaaaaatgtgaacacccgagcctggatgcagcactaataatcaacattgttcttggtttagttaaagaaaatttggccactggcaaaataccatttgggagtaatgagacacacccctaatcctaaaatattttcttgtcacttcctcaaagttgtttttgactttttttccttcagggttgacttcatatgtgttcattttattctaataagcaaaagttgtaatttttaagtgaaaaaataatttatgtcattctacttacaaatacaatttttctattctatatactca

SEQ ID NO: 140940 - DNA, 1534 bp, Homo sapiens
  Payload ID: 7666
  Gene Symbol: HIST1H2BG
  Gene Name: histone cluster 1, H2bg
  Uniprot ID: P62807
  ENST ID: ENST00000541790
  CDS Start-End: 50-430
ttttatttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatattagccgggcgtggggcagtcgcgtgtcatcccagagactcgggaggctgccgcaggagaatcacttaaacccagcaagcaaaggttgcagtgaaaagacatggcgcttttgcattctagcctgggcgacaaaggcgaggcttcgtctcaaaaaaaattgatcaggagatactcctgttctgtgttggcaagatcctgtaatcctagcactttgggaggtcgatgcatgaggctttcttcagctcaggagttaacagatttgcctgggcaacatagaactcgtctctgcaaaaaaatgaagctaaccaggtgtgacggcttgcgtctgtactatcatttactcggtaggctgaggtggtaggatagcttaaactctcgggctagagactgcaggaacatgtgaatacgctagtgcaattccagcctgggcaacactggaaagggtaggaagagtagtctttgggtccctaaagatcacctgataacaagtttgacttttctgagcactcttgtggagtttgttgtggagggaataccatgggcattggcaatgtaaagttgatctaaaaaatctcgttttccgccgtgcgcggtggctcacgcctctaatcccatcactttgggaggccgagacgggcggatcacgaggtcaggaggtcgagaccatcctggctaacactgtgaaaccctgtctctactaaaaaaatacaaacaaaattagccgggcgtggtggcactcacctgtagtttcagctactctggaagctgaggctggagagtcacttgaacccgggaggcggaggttgcagtgatcagagatcgcgccactgcactccatcctgggcgaaagagctagattccatctcataaaaaaaaaaaaaaaaaaaaaaaaaaaaaa

SEQ ID NO: 140941 - DNA, 2060 bp, Homo sapiens
  Payload ID: 7667
  Gene Symbol: HIST1H2BH
  Gene Name: histone cluster 1, H2bh
  Uniprot ID: Q93079
  ENST ID: ENST00000619466
  CDS Start-End: 1-381
atgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagtacaccagctccaaataaatggacgcatgttcaaacccaaaggctcttttcagagccacttaatgatttcaattaagagttttaatgctgggtgctgctgtattctatgggagaagtgtcgccaatacaggtaaaattttcctacatcacctgtttattctgtgcgtttgacaaacactaagcttttagagtttatttgtctttataaaggtggggtacaactacattgttcaggctggtcttaaactcaagcgctggtcttaaactcaagcaagttttcccacctcggccttgccttgtattactgagcagataatttgacacagcaggaaaagtgggcattcttgtttaggaaccaaaaactaagtttgcaacttaaaatgcaatcaatttggagcaacacgtccaccagtctagagctggtaagtttgagtattcaaaatgagttgaaagtacatttagtgcctataataacccactctagatagcataatgtggtctttgtaggagtctcgtggaagttaatgttaactgggatattgtagtttaccaagtacctgagaaaaatttaaatttcttaatagataaggattaggagacaaactttatggaaatgaaaacaaaatgccatgcaataaacctttagttatttggcaagtagtatgagggcttctagctgtctttgaaaaacttaagatttgtaagacaaggaagagcagagaatataaatagtaaagggcctggcaacaatgtgtctttgtttttaggtaacgttggttggcagtcagcaaaaaggccaggctcaggcagtcttaacttgaaaacgctaacaggaatcaccaaaactatgtatacaactcctgctgtgggttttttaaatatcaagattaccgattttaatggtagggtaatatagactgaaatccccacattcctccaccctcatgggcatttctcttggctcataaaatatgggggtagcaggaggaaagggaagagtatattaagagcctatatctgagaggtacgttcagtttttcctcaaaagtatctggtggttggactagtaatttattcatttattgagaacctattaaattacagaaaatacttagtaaagagcagtgagaaagatagaaactatccctgtcctttacctggattgaaatctaaagtggatatttgtacaataaactcacaaactaaagaaagaaacgtaagtctgaaggtcacgtttttcttttaaccggcttttgatgggactgaatttaaattgccaaaaggtgaattaacataatcttgaaaacttgcaagttcctggaggcagttctggagggagggtggagcaaaagagatggcagaagaagaggagccagcagcactggaattcaaaagtagacattcttgcctcctccctagtggacagggaggaggggtggggagagcacaagagagccgtgacagaggaagggagagagcacagagtttaagtctatattgatggaactatggttacaaataggggctacccatttatattctcatctggccatgtctcatcagtgatttacaaggatttcatagaagtgctttaataaaatgtacaacctcactgaaatatagaaagtaatactataagacagcaaatattgtatatttatgcaaataattttttaataaaaggtttttttaatgtc

SEQ ID NO: 140942 - DNA, 381 bp, Homo sapiens
  Payload ID: 7668
  Gene Symbol: HIST1H2BI
  Gene Name: histone cluster 1, H2bi
  Uniprot ID: P62807
  ENST ID: ENST00000377733
  CDS Start-End: 1-381
atgcctgaaccagctaagtcagctcccgccccgaagaagggctccaagaaggcggtgaccaaggcacagaagaaggatggcaagaagcgcaagcgcagccgcaaggagagctattccgtgtacgtgtacaaggtgctgaagcaggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaa

SEQ ID NO: 140943 - DNA, 381 bp, Homo sapiens
  Payload ID: 7669
  Gene Symbol: HIST1H2BJ
  Gene Name: histone cluster 1, H2bj
  Uniprot ID: P06899
  ENST ID: ENST00000339812
  CDS Start-End: 1-381
atgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaa

SEQ ID NO: 140944 - DNA, 408 bp, Homo sapiens
  Payload ID: 7669
  Gene Symbol: HIST1H2BJ
  Gene Name: histone cluster 1, H2bj
  ENST ID: ENST00000606923
  CDS Start-End: 1-65
acgacattttcgagcgcatcgcaggtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgcta

SEQ ID NO: 140945 - DNA, 950 bp, Homo sapiens
  Payload ID: 7669
  Gene Symbol: HIST1H2BJ
  Gene Name: histone cluster 1, H2bj
  Uniprot ID: P06899
  ENST ID: ENST00000607124
  CDS Start-End: 1-381
atgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgctatgttttccttattcattggcttattatctttactatcccatcctccacactaaaagttttttcgagctggatttgggagttgtggggtaggttatattttgatcacttgtatttcccagcttctagaacagtgcccagcaaagtacttctctgaataaatgaataaagtaatattcctctgc

SEQ ID NO: 140946 - DNA, 381 bp, Homo sapiens
  Payload ID: 7670
  Gene Symbol: HIST1H2BK
  Gene Name: histone cluster 1, H2bk
  Uniprot ID: O60814
  ENST ID: ENST00000356950
  CDS Start-End: 1-381
atgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaa

SEQ ID NO: 140947 - DNA, 488 bp, Homo sapiens
  Payload ID: 7671
  Gene Symbol: HIST1H2BL
  Gene Name: histone cluster 1, H2bl
  Uniprot ID: Q99880
  ENST ID: ENST00000377401
  CDS Start-End: 26-406
ttggttttgccactattgtttcattatgcccgagctggccaagtctgctcccgccccgaagaagggctccaagaaggcggtgaccaaggcccagaagaaggatggcaagaagcgcaagcgcagccgcaaggagagctactccgtgtacgtgtacaaggtgctgaagcaggtccaccccgacaccggcatctcttctaaggccatgggaatcatgaactccttcgtcaacgacatcttcgagcgcatcgcaagcgaggcttcccgcctggcgcactacaacaagcgctcgaccatcacctccagggagatccagaccgccgtgcgcctgctgcttccgggggagctggccaagcacgcggtgtcggagggcaccaaggccgtcaccaagtacaccagctccaagtaaattctcaagctcttgtccaacccaaaggctcttttcagagccactcactattatctaaagaagagctggttcgctcttccta

SEQ ID NO: 140948 - DNA, 381 bp, Homo sapiens
  Payload ID: 7672
  Gene Symbol: HIST1H2BM
  Gene Name: histone cluster 1, H2bm
  Uniprot ID: Q99879
  ENST ID: ENST00000621112
  CDS Start-End: 1-381
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtga

SEQ ID NO: 140949 - DNA, 432 bp, Homo sapiens
  Payload ID: 7673
  Gene Symbol: HIST1H2BN
  Gene Name: histone cluster 1, H2bn
  Uniprot ID: Q99877
  ENST ID: ENST00000396980
  CDS Start-End: 1-381
atgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaaataatgtctccatagaatcactttccaatacaacggctcttttcagagccaccta

SEQ ID NO: 140950 - DNA, 715 bp, Homo sapiens
  Payload ID: 7673
  Gene Symbol: HIST1H2BN
  Gene Name: histone cluster 1, H2bn
  Uniprot ID: Q99877
  ENST ID: ENST00000449538
  CDS Start-End: 118-498
acgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaattgtaaaaca

SEQ ID NO: 140951 - DNA, 4137 bp, Homo sapiens
  Payload ID: 7673
  Gene Symbol: HIST1H2BN
  Gene Name: histone cluster 1, H2bn
  ENST ID: ENST00000606613
  CDS Start-End: 62-562
gttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaattgtaaaacagtgtcactctttttattttaaaaaatagctatttttcataaaatatgtatgctaacataaaatgggtttattactgttatttttaaatgaattaaccaaatttttttgttttactatataatacggtaaatgtcaatagttataacctacagaaacacaaattctttggattgcaaagctccaccacctaatatgctatagatcaaggttcaaaagagagctccctggaaaactccttggtgttttgttcactgaaatattatttaaggagaacatattttattttaatgactgtcattgctggcatccgaactctaattcccaaggcatcctcaaattatcatctgcatcacttcattactttttaagagtgtaagtgggtcatgagaccagaaggttcaagaactgctgccttagggtatataccacactagtaatgttcatttgtgttcaaatgactatttttcaaagtatttggagtatcccttcctgcacacttatgttatgatctagatatacagatccatttactttgttttgctgttgatgtctaggattggactttttaatgtttggttctatcattacataaaatatttttacatagtcccaaggtcaaatcaaattatatccaaagaaatctttctccttcatgctaatagcctctcttgccttagagtaataattttaaaggttatgatatatccttctgttgtttattataagcatatatgtatgtattcttagggaatattaacttcattttgctgttgatgtctagggattggactttttaatatttgtttctaccgttacataaaatatttttacatagtcccaaggtcaaatcaaattatatccaaagaaatctttctccttcatcctaatagcctctcttaccttagagtaataattttaaatgttatgatatatccttctgttgtttattataagcatatatatatgtattctagggaagattaactcgtatcacaggagaggagactggaagttgatactatgcaagataaactttgtcacagacagtcacctgttctttggagggcccattcatctttcccaaaaataatttcctctcccctacattgcctacatcccccttcctgtcttccctatgaagacagtatataagcttctagatctcactgggcttggggggcattcacttatttttcatgtgatacctccatgcacaaaataaaatttttttttttcgagacggagtcttgccgcgtctcccaggctggagtgcagtggcgcgatctcggctcactgcaagctccgcctccggggtttaggccattctcctgccccagcctcctgagtagctgggactacaggcgcccgccaccatgcccggctaatttttttgtgttttcagtaccgatggggtttcactgtgttagctaggatggtctcgatctcctgacctcgtgatccgcccgccttggcctcccaaagtgctgggattacaggcgtgagccaccacgcccggccacaaaataaatttttatatctttctcttattaatctgcctgctgtcaatttatttcatacacttaattatcaaaccctcagagggcagagggagtcttccctcccctacagttccaatcagattgttttctagttagcatgagggttgatctaagatgtctggtctaccattactgaaaataattactaaaaatagaatcaatggtatagtatttgttaacatgttttaaaaatatcaataactaaattatcatagggcttccaattcttaaaatcttcaaaatgcagttgtataaaatgatatagatcagtgccgtcatactctctggtccagggatgggtttcccatataaataattcaaattctcactaacgatgtttaagttaggaaattagttgccatgttggttcagttgtgtatcaccaccaaagaagtgagttgctaaattaaatataaataaatacttagccatagaactagaggaaaagattaaacaatgtattgttggatcaagaaatcatgtttcaaaatttaaatcaatgacttttatagttcaagtgtctgtgaagtctaaaataaaaatacagacattaattgcactaccttattggtagaagaaatagcaagtaccttaaaaagtgcatgtcatattggaatcaaatctcttgaaggctaggctagtggtaaaagaaatagtaggtaccttagaaactacatgtcatatttgaatcaaatctcttgaaggctaggcaattcatcttgactatatttttgtcaccaaagagcttaatattgaaccatcaaaatatattcactttaccatctgggacattttaatcaaacctctcatctgttcaatcacatctttcacttcagaaagaactttcacttctgccttgtttttcagaactatctatagccaccacttttcacattaagatgatccttctcaagccatcagagaactaagtgacatctgcaatgaaatggcttcaccacttctgtcctcgggtaattctgcaatctatttttgctggatccaatccctgaagaccatcctgcctttctaagggatgcttctccctttcagctaccttcatgtcttttaatgcaattgttgcttctttctgtcctggtgttgtactttggcagtggtcacacccatggagcacagacttctacaaggcacaaggcatgactttgatttttctgttgtaatttgatggaattggccaggcgtggtagctcatgcctgtaatcccagcactttgggaagccaaggcaggcggatcacctgaggtcaggagttggagactagactggccaacatggcaaaaccctgtctctactaaaaatacaaaaattagccgggcatggtggcgggcgcctgtaatcccagctattcgggaggctgaggcaggagaatcgcttgaaccagggggtggaggttgcaatgagccgagatcgtgccattgcactccagcctgggtggcagaatgagactctgtctcaaaaataataataataataataataattgatggaattaagaaatattgaaaaatatataccattcactgtgagaaaaaagttcaactcctcaaactgggaatctcagtccattttatgtatgaaggtgatggcctgcactaaccttttgaggctgctatcatcctatgcctattttatgggtgaaaaaattgatggacagagaaagggagcattttcagtatatcacctagagaatcagtgacagagtcagtctatgaatcttgtggtggtgggtggccttcactgtagaaaggatagattccatgatcttttgtaccatcaaataaaatacttacaaacaaatgagaattagccatttgtatttgttttgttttaatagtgcaaataagatgtcattctagacctaaaaaaatgtttttctcccttttgtttccaaattttaggataaaaggcaaataaaaatctgttcttaga

SEQ ID NO: 140952 - DNA, 1723 bp, Homo sapiens
  Payload ID: 7673
  Gene Symbol: HIST1H2BN
  Gene Name: histone cluster 1, H2bn
  Uniprot ID: Q99877
  ENST ID: ENST00000612898
  CDS Start-End: 903-1283
caaaacaatgtggtgtaaaagccgtttagttttgcttcatctccatacagcattccagtgccattgcaaaatgactcgactatcagataaaactgaacacagctctacttggtgaaaaagtaggtggctctgaaaagaacctttttggtttggaccgaggtatgagtaatgaactgctccagccccgctacttgcccttggccttgtggtggctctcagttttcttaggcagcagcacggcctggatattgggcaggacaccaccctgggcgatggtcactttaccaagcagcttgttgagctcctcgtcgttgcggatggccagctgcaagtggcgcgggatgatgcgggtcttcttgttgtcgcgggccgcgttgccagccagttccaggatctcggcggttaggtactccaacaccgccgccaggtacaccggcgctccggcaccgacccgctcagcgtagttgcccttgcggagcagtcggtgcactcggcccactgggaactgaagacccgcccttgaagaacgggtcttagccttggcgcgagctttgccgccctgcttgccacgtcccgacatgacgtaaaaaattcaatcagtaacgttcctgagactgacgtaacgctaaagctccgctacttatagtcaacagaggcacgaaaactaagctgtgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggtcagtctcggcccacaccccaaaggctcttttcagagccactcagtcttcccaaagagaactggcactcactgttcttacagcaggtatttcttacttgctacaaagacgatttccaagattcctttagccttgttagaaactaattttggctcaagcctctaatcccggttcgggaaaccgaagcgggtggctcacctgaggttagaagttcgagacgagcctagccaacatggtgaaacccgtctctactaaaagtacaaaaaaatagctgggcgtggtggcggacgcctgtaatcccagctacccgggaagctgaggcaggagaatcgcttgaacccggcagatggaggttgcagtgagccgagatcgggccattgcaccccagcctgggcagtaagagcgaaactctgtctc

SEQ ID NO: 140953 - DNA, 381 bp, Homo sapiens
  Payload ID: 7674
  Gene Symbol: HIST1H2BO
  Gene Name: histone cluster 1, H2bo
  Uniprot ID: P23527
  ENST ID: ENST00000616182
  CDS Start-End: 1-381
atgcccgacccggctaaatctgctcctgcccccaaaaagggctccaagaaagccgtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtga

SEQ ID NO: 140954 - DNA, 411 bp, Homo sapiens
  Payload ID: 7675
  Gene Symbol: HIST1H3A
  Gene Name: histone cluster 1, H3a
  Uniprot ID: P68431
  ENST ID: ENST00000613854
  CDS Start-End: 1-411
atggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtga

SEQ ID NO: 140955 - DNA, 411 bp, Homo sapiens
  Payload ID: 7676
  Gene Symbol: HIST1H3B
  Gene Name: histone cluster 1, H3b
  Uniprot ID: P68431
  ENST ID: ENST00000621411
  CDS Start-End: 1-411
atggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaa

SEQ ID NO: 140956 - DNA, 411 bp, Homo sapiens
  Payload ID: 7677
  Gene Symbol: HIST1H3C
  Gene Name: histone cluster 1, H3c
  Uniprot ID: P68431
  ENST ID: ENST00000612966
  CDS Start-End: 1-411
atggctcgtacgaagcaaacagctcgcaagtctaccggcggcaaagctccgcgcaagcagcttgctactaaagcagcccgtaagagcgctccggccaccggtggcgtgaagaaacctcatcgctaccgcccgggcaccgtggccttgcgcgaaatccgtcgctaccagaagtccaccgagctgctgatccggaagctgccgttccagcgcctggtgcgagaaatcgcccaggacttcaaaaccgacctgcgtttccagagctctgcggtgatggcgctgcaggaggcttgtgaggcctacctggtgggactcttcgaagacaccaatctgtgcgctattcacgctaaacgcgtcaccatcatgcccaaagatatccagctggcacgtcgcatccgtggggaaagggcataa

SEQ ID NO: 140957 - DNA, 411 bp, Homo sapiens
  Payload ID: 7678
  Gene Symbol: HIST1H3D
  Gene Name: histone cluster 1, H3d
  Uniprot ID: P68431
  ENST ID: ENST00000356476
  CDS Start-End: 1-411
atggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaa

SEQ ID NO: 140958 - DNA, 462 bp, Homo sapiens
  Payload ID: 7679
  Gene Symbol: HIST1H3E
  Gene Name: histone cluster 1, H3e
  Uniprot ID: P68431
  ENST ID: ENST00000614911
  CDS Start-End: 1-411
atggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaacca

SEQ ID NO: 140959 - DNA, 2679 bp, Homo sapiens
  Payload ID: 7679
  Gene Symbol: HIST1H3E
  Gene Name: histone cluster 1, H3e
  ENST ID: ENST00000634733
  CDS Start-End: 361-771
gtcattctttaagaatcttttccagtaaacatttgttactttttcaaagtaattgggagctgttgagtgtggaagcgaaaaccaagttaagaagtcctgttatttgggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttagctggctttgttttgctgttcaggccctctgctgctttcttgtacattgttctcgttttctaaactcctggccacttaattgtaccctgcttaacccatcctcttgttttctggctcaacgctctttcatgtggtggcctgcattttaggtcttaactgcataggctttcaacgccttggttttgcctttccttgatgtttatttgaccttgcccgaggggccagcgcttttgatctgcatcaggctgccttactccactagtgttttgagacccagctacttgccggcgacggtcggtgccttgggtgcggtcaacgttactctctgtgcgcctgatactggtctaaggctaaggttattagctggaacacctagacccgtggcactaacacacagctcttgcagacttgacagccttgcataggttctaaactgcaggagtcaaagcaacgaaggtgcagatgggtgtgtctcaaacctgagtgcgaaaggaaaatgcagaaatcatgagccttttcaactttccagttgatatcttttgtttgcttttttcttttcttatttatttatttatttatttatttatttatttatttatttattttgagacggagtttcgcccttgttgcccaggctggagtgcattggcgcgatctcggctcaccgcaacctccgcctcccgggttcaagcgattctcctgcctcagccttccgagtagctgggattacaggcatgagccacctcgcccggccttccggctgatatcttaaaagaacttttcaactttagtaaataccctgtcttaatcaaatctcattaaaagtaccccatatttatcaacaaaacatgaaaatccttggacggcttcaaagttcttacagaaaatattctgcctttcctttccatacaaaggcacagcttcgaaactggtaggtgaagggaaggaaaataaggaattctgttacgaaatcatacaggctgttatttggaaatacagaagggtgtatgtactatatgggatactgcatgctatttggaagaattttgtttatttaaacatttcagcaaattcctcagttttgatatggggtgcagtatttttaactcattgagaaatttctactaacttttttgaatgtgctcttttcccactagttgcactaaggaaagaggttagtcatgtggtaaaattaatagtgacaaagctgtaaatagctctgcaggccaaggtagccatagtaagaagtcctggagatttatggaagaaatttttgttcatggaagcctgtcagacatgaagatgtgggtcttgtgaattggagattcagtgcgtgaggaaaacagcctaactatccataattaaggtaactactgtcagatatttgtaacatagtgaacatcctattatgctagatagaagcattctctatttgaatgttgtttcctgtatcctgtactttctttaagattctagctcaacaagttttaacctgtatttctcttacagctactggaattcagtacgtgaggacttggacttggtgggcacagaatgcatctttttatatcattaaatccaccagaacatctagcatggtcatttgcctaaaacaaagcctctggaaatttagtcaagttgagatgtaaaataaaagattactgaacagaa

SEQ ID NO: 140960 - DNA, 411 bp, Homo sapiens
  Payload ID: 7680
  Gene Symbol: HIST1H3F
  Gene Name: histone cluster 1, H3f
  Uniprot ID: P68431
  ENST ID: ENST00000618052
  CDS Start-End: 1-411
atggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataa

SEQ ID NO: 140961 - DNA, 2411 bp, Homo sapiens
  Payload ID: 7681
  Gene Symbol: HIST1H3G
  Gene Name: histone cluster 1, H3g
  Uniprot ID: P68431
  ENST ID: ENST00000614378
  CDS Start-End: 432-842
gccttataatggtcaaaggtttccagctagcagcagtccaggtgactcaagaaaacggcacaagataaacttctcaaaacgtggtcctccgaatctggccccacaacacatctactgaatgagaattagcgtcttccaagtcttaaagtagtcgtttacggactacagcttgagaagcgcagaattagaactttaagaagttaacgttcttggatcgcagactaaccgagaagagaggattcaaaaatgaagtgattcatccaatcagattttccagtaattcaccaatcacatcgttggactcttcagccaatggttttgttgcgcgggtcttttgaaaatcaacaaggccaattagaatgtttctgagtatatataagggcagtttccactctgccaagtggctgagtttttctttcaggtagtctgagatggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtagaggtttccgggcagtaattctatccaacttaaaaaggctcttttaagagccgcctactttcacccgaaaatagctgtgattaactaatcaaatctttgaaactaaacattggttttagtacttaagtcctcatttgattggctaaagttaatggtaagcttgctatatttgttcccgtgctttttcccgaaagtgccagattgtcagcgtccttttctaaactggcttttaggggtttggagcttcgatttggtagtggaaggggccacctgggggcgtttatatacattgtctcaagcgttagtcgcgttgtctacttacacccattatagatgggattttttttcgttgtgtatttctggttaatcccttttaaaactttacaggtatgagcattggcagttgagagtaggtagggatatccttggttgctgctttttcgtgtctgaagcagctatttccacaattccccctttttttaaacagttcttggtttttctgtgaaatgatccattttttaattcaatattagaaattggcggcagaaacgaaagccagattggcctctacattactggcagcatgggcattacgtgggaacttgttagaagctcccagggcattacatgggagcttgtttcaatccccatctagggctggagtcaatctgcatatacctcagatgattctcatgaacactgatttaggaagcctaggttgttggttttggtctcatcagtaaaggcatcctgcctgtgaactcttacaaggagtgagcttttgcaaaatgcatgtttatttatgttacagaatgaaatattctatgaaatgttctctaaagcaagtgcacagaacaatcccctaaaatagtttgatttctttacagatcagttttctcaatgtaacattacagtcacatgggaaggctttagaaaaatctttacctggggttcaatgagactaatagcaatctagagtgggcccagggaatggtaattattaaaattcaggtgcttctaacagctggggctgagactccttgctacataaattttaatactcttattagctctggtttgactctaggcttagcagttttctaattgaatcagtttccttgtagtttgccttcagagagaatatactggtctctaaagactttctggcttgcttgactatctttcaacacctggcttttataagaatttcttagggcaacactaatgtaagttttttcttttttgttttgttttgttttttgtttttttgaaccaccgaggtccttttagtgattggaagtatcaggtttttagggatgttacaaggaggaacacataccatcctgggctgcttggcatacaaccaagatatgttttcatatagaacccttcctttacagattagcacaaggccctgtttgggtattcagcagatccttctttatgatctttattaatttagcaacttgtcattttttttcacatattgcttttattttaaaaacttatttgacattccagaatatatgggaaaggagataatagtttaataaaacctatgttcctctca

SEQ ID NO: 140962 - DNA, 1237 bp, Homo sapiens
  Payload ID: 7682
  Gene Symbol: HIST1H3H
  Gene Name: histone cluster 1, H3h
  Uniprot ID: P68431
  ENST ID: ENST00000369163
  CDS Start-End: 11-421
ctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccagaaataaaactaaggttgtactgaagttggaaaaattcaggttaatgtagctcatgctggctaaagtgaaacgttctctccccgccccccgttcctaagcagtgttaagttttctttgaattttttcaagccggattttgggcctgcttaaaccacttaaatgtagttaatgacagatggtttgaggtttaaaagtcttctggagaaagcccgccagagaacattccctttgaagccccatgtaaaaatacgtgtgggagagaaagtgttttctctgacttctgctgacagtggctaaaactctgaactgtcaggagtattcaaaataagactgccttgtaggtaagcctgtggtagtttttttgagcacaggataaaatacttgagtctttgcttaaatgttactttctcaatgaggctttgtatgactaaataaaatctgtataatccccac

SEQ ID NO: 140963 - DNA, 411 bp, Homo sapiens
  Payload ID: 7683
  Gene Symbol: HIST1H3I
  Gene Name: histone cluster 1, H3i
  Uniprot ID: P68431
  ENST ID: ENST00000616365
  CDS Start-End: 1-411
atggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataa

SEQ ID NO: 140964 - DNA, 411 bp, Homo sapiens
  Payload ID: 7684
  Gene Symbol: HIST1H3J
  Gene Name: histone cluster 1, H3j
  Uniprot ID: P68431
  ENST ID: ENST00000359303
  CDS Start-End: 1-411
atggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataa

SEQ ID NO: 140965 - DNA, 312 bp, Homo sapiens
  Payload ID: 7685
  Gene Symbol: HIST1H4A
  Gene Name: histone cluster 1, H4a
  Uniprot ID: P62805
  ENST ID: ENST00000617569
  CDS Start-End: 1-312
atgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaa

SEQ ID NO: 140966 - DNA, 438 bp, Homo sapiens
  Payload ID: 7686
  Gene Symbol: HIST1H4B
  Gene Name: histone cluster 1, H4b
  Uniprot ID: P62805
  ENST ID: ENST00000377745
  CDS Start-End: 1-312
atgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtat

SEQ ID NO: 140967 - DNA, 435 bp, Homo sapiens
  Payload ID: 7687
  Gene Symbol: HIST1H4C
  Gene Name: histone cluster 1, H4c
  Uniprot ID: P62805
  ENST ID: ENST00000377803
  CDS Start-End: 73-384
ttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaa

SEQ ID NO: 140968 - DNA, 312 bp, Homo sapiens
  Payload ID: 7688
  Gene Symbol: HIST1H4D
  Gene Name: histone cluster 1, H4d
  Uniprot ID: P62805
  ENST ID: ENST00000614247
  CDS Start-End: 1-312
atgtctggccgcggtaagggcggaaagggtctaggtaagggtggcgccaagcgtcaccgtaaggtattgcgtgacaatatccaaggaatcaccaagcccgctatccgccgcctggctcgccgcggcggcgtcaagcgtatttctggcctcatttatgaggaaactcgcggagtgctgaaagttttcctggaaaatgtaatccgcgatgctgtcacctacacggaacacgccaaacgcaagacagtcacagccatggacgtggtgtacgcgctcaagcgccagggacgcactctttatggcttcggcggctga

SEQ ID NO: 140969 - DNA, 1487 bp, Homo sapiens
  Payload ID: 7689
  Gene Symbol: HIST1H4E
  Gene Name: histone cluster 1, H4e
  Uniprot ID: P62805
  ENST ID: ENST00000615164
  CDS Start-End: 94-405
agtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtcaacaggtacgtatatttttcagccgttttttttttttcgttccaaattacatttggggtttcggcatacgattttttaggctacgatccttttatgtttattgtagtagggccttagattgcactgaaaaggctagggtaatagtgtctgtttaccttaccacttttattttgagtacctaaaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttctattacttaacctaacgaccgagtttaggtgtgtagaagttcctggggtagataagctcacgcaaggagaggttgcaagcattcatttcggaattctattaagccaacccagttgtcccttagaagttatgatatttgctgttttttgaataaaagaatttgactctctttaaaccctaaagcttgaaatttagcatttatctcacatgagacaaatgtttaggaactcatgtttaggaactcatgttcctgcctgaggcaggaactgaaacaccagatcacttgcatcgagaccgtgagactccctatgtttcatccatcatgattgcgtccttatccctccctgatttcctgttttctcgcccttctcgctacataagccccccaattttggtcggggagacggatttgtgatttcatctcctccctcatgaatactcatagaatttttccaaacctactgaatctgtatgtaaggttgactctgtaaggcatatatatattccagctccccttcactgccacagagcgctcattccatcctgggattacttctccctctgaaaataaagtctttgttacttcctg

SEQ ID NO: 140970 - DNA, 312 bp, Homo sapiens
  Payload ID: 7690
  Gene Symbol: HIST1H4F
  Gene Name: histone cluster 1, H4f
  Uniprot ID: P62805
  ENST ID: ENST00000244537
  CDS Start-End: 1-312
atgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctga

SEQ ID NO: 140971 - DNA, 297 bp, Homo sapiens
  Payload ID: 7691
  Gene Symbol: HIST1H4G
  Gene Name: histone cluster 1, H4g
  Uniprot ID: Q99525
  ENST ID: ENST00000611444
  CDS Start-End: 1-297
atgtctgttcggggcaaggccggaaaaggccttgggaaaggcggtgccaagtgccatcgcaaggtactgagcgataatattcagggcattaccaagtgcactatccggcgcttggcccggcatggcggtgtcaagcgcatcttgggcctcatttatgaggagacccgccgggtgttcaaggtgttcctggaaaatgtgatctggtacgccgtgaccaacacggagcacgccaagcgcaagacggtcaccgccatggccgtggtctacgtgctcaaacgccagggaagaaccctgtaa

SEQ ID NO: 140972 - DNA, 397 bp, Homo sapiens
  Payload ID: 7692
  Gene Symbol: HIST1H4H
  Gene Name: histone cluster 1, H4h
  Uniprot ID: P62805
  ENST ID: ENST00000377727
  CDS Start-End: 11-322
ttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaa

SEQ ID NO: 140973 - DNA, 1034 bp, Homo sapiens
  Payload ID: 7692
  Gene Symbol: HIST1H4H
  Gene Name: histone cluster 1, H4h
  ENST ID: ENST00000635491
  CDS Start-End: 36-347
aggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcagttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagaccctgctacttacttgacatctcaacttgaaagtccaattaatatgcacttcaaactttaataggcttcaaacagaatttctttcattatctctgcaaaacagcttctctcatcatcttgaaattagtgaatggcattttactgttttagttggagtcatttctgtggttttctttcacatcctacataacaatccatcagtaagttctatgagctcttctttgaaaacaaacagaatccaactgtttcattcccacttctgctctggtcaagccactgccaacactcacctttattattgtagcaccctcattgcctagttctgtcccacagatttccaataaaaggtgaataaaatcaggtcactcttctgct

SEQ ID NO: 140974 - DNA, 1034 bp, Homo sapiens; identical to SEQ ID NO: 140973
  Payload ID: 7692
  Gene Symbol: HIST1H4H
  Gene Name: histone cluster 1, H4h
  ENST ID: ENST00000634560
  CDS Start-End: 36-347

SEQ ID NO: 140975 - DNA, 2163 bp, Homo sapiens
  Payload ID: 7692
  Gene Symbol: HIST1H4H
  Gene Name: histone cluster 1, H4h
  ENST ID: ENST00000634956
  CDS Start-End: 140-451
gggtggggccaagaagcaggaccaaagttccggtatgcgcgctttcagtcttcaattaggtccgaattcccggcatataagggcgttgctttgccttggcgtttaggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcagttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagaccctgctacttacttgacatctcaacttgaaagtccaattaatatgcacttcaaactttaataggcttcaaacagaatttctttcattatctctgcaaaacagcttctctcatcatcttgaaattagtgaatggcattttactgttttagttggagtcatttctgtggttttctttcacatcctacataacaatccatcagtaagttctatgagctcttctttgaaaacaaacagaatccaactgtttcattcccacttctgctctggtcaagccactgccaacactcacctttattattgtagcaccctcattgcctagttctgtcccacagatttccaataaaaggtgaataaaatcaggtcactcttctgctgaaaaccctccaatggctctcatttcgctaaaaagaaaacccaaagtcctttcagtaccttgcaaggccccacactctggctcttgttatctctttggcctcaaatcccactactcctttccttcctcgcgcagctccgctagcctcaaacttgcttgtctctctctgttgctcaggctggagtgccgtaacgggatcatggctcactgcaacctctgcctccctggctaaagtgatcctcctgtctcagtctcttgagtagctgggactacaggtgcacaccaccacaccggagtaatttttgtattttctgtagagatggggtttaaccatgttacccaggctgtcttaaactcttgggctcaagtgatctgcctaccacggcctcccaaagtgctgggattataggcatgagctactgtgccgggcctgataaaacctatttttagtgaaactcttgctcttctacatatttccaatttttagccacaataaacaaaaatatgttaaaatagaatcaatagaataggattttgtatattattaaatatatgatgaaaatgaatggtggtaatctaggatgaggaccaaatttcaaacttggataagcagagctatgaggataatgaggccagtcttggtcctgctgggtttgagccacctgtggaatacttagttcatatagtatttggaagactaattactgcacttcttgttatagactgatttaccctcctccctgctgcatatgttgaagtccttgaaaatatgactgcatttagagttagggtcgttaaagatataaaatgaagttattgaggtgggtctgaatccaatctgactggtgtccttataagtaaagaagactggacacacacacagagaaaagataatgtgaagacacagggagaagacagttatcgacacaccatggagagagacctcagaagaaatcaaccttgcccacagggttaatcttaagagtcgtagcctccagaattgtgaaaaaataaatgtttaagcca

SEQ ID NO: 140976 - DNA, 1294 bp, Homo sapiens
  Payload ID: 7693
  Gene Symbol: HIST1H4I
  Gene Name: histone cluster 1, H4i
  Uniprot ID: P62805
  ENST ID: ENST00000615353
  CDS Start-End: 722-1033
ctgcagtagataatgaggtaaccgaaggcaattgtgcttcttttgataagaagctttcttggtcatatcaggaaattccagagaaagtccctccctgtatttggggaagagaaacaggacaaagttagagggaccttgattcttagacttgtttctgagaaccctcaattttcaaaaacacccaccattaccaagctcgatatttggggggataattctccaccccaaacactagaaatgaaaataagtagaaaagaacttagcaatatacctgaacgatctttaaattctatgagtctatcttgttctattgctaggaatttagcatatggagtatatttccattgtatattaaggagaaaaatgccacaaaatagcatagttccatacaaataatgttaaaggaaaacatgcatatatgcagagataacattctttttgctttatgtatcttctataatgttaacatttttgttatgaggcaggaatcatgttaaatgaaaaaaggaaaaacagcctaggtcttgaggattaaaaaggactgaaggagaacaagagggagtagagcacagcaggcctgtttcccttttaggtcccctcccccaatgcagagggacttcccgccaaagctcttccggttttcagtctggtccgcagaggttacccataaaagaaagctgccatcacaggcagcagacctttgttctctgaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatggacgtggtctacgcgctcaagcgccagggccgcaccctctatggcttcggcggctaaatggcattttgaagcccagtcattctctaaaaaggccctttttagggcccctaagctttcaacaaaagagttgaaatgactgcaaactgagtctcttaatagggccattgtcagtgagttctgtcatcctattttacaagattaactcgacgccgaaaatgggctgatgactacaggtgaccttgggccgagatttttccaaggccagaagagcctctgctggccagtaacttctggcggctgcctggaaattgcctgcag

SEQ ID NO: 140977 - DNA, 373 bp, Homo sapiens
  Payload ID: 7694
  Gene Symbol: HIST1H4J
  Gene Name: histone cluster 1, H4j
  Uniprot ID: P62805
  ENST ID: ENST00000355057
  CDS Start-End: 18-329
gactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaataaaaggcccttttcagggccacccta

SEQ ID NO: 140978 - DNA, 312 bp, Homo sapiens
  Payload ID: 7695
  Gene Symbol: HIST1H4K
  Gene Name: histone cluster 1, H4k
  Uniprot ID: P62805
  ENST ID: ENST00000611927
  CDS Start-End: 1-312
atgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttga

SEQ ID NO: 140979 - DNA, 312 bp, Homo sapiens
  Payload ID: 7696
  Gene Symbol: HIST1H4L
  Gene Name: histone cluster 1, H4l
  Uniprot ID: P62805
  ENST ID: ENST00000618305
  CDS Start-End: 1-312
atgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctga

SEQ ID NO: 140980 - DNA, 549 bp, Homo sapiens
  Payload ID: 7697
  Gene Symbol: HIST2H2AA3
  Gene Name: histone cluster 2, H2aa3
  Uniprot ID: Q6FI13
  ENST ID: ENST00000369159
  CDS Start-End: 39-431
ccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctg

SEQ ID NO: 140981 - DNA, 564 bp, Homo sapiens
  Payload ID: 7698
  Gene Symbol: HIST2H2AA4
  Gene Name: histone cluster 2, H2aa4
  Uniprot ID: Q6FI13
  ENST ID: ENST00000607355
  CDS Start-End: 54-446
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctg

SEQ ID NO: 140982 - DNA, 393 bp, Homo sapiens
  Payload ID: 7699
  Gene Symbol: HIST2H2AB
  Gene Name: histone cluster 2, H2ab
  Uniprot ID: Q8IUE6
  ENST ID: ENST00000331128
  CDS Start-End: 1-393
atgtcaggacgcggaaagcagggaggcaaggcccgcgctaaggccaagtcgcgctcgtcccgcgctggtctccagttcccggtggggcgagtgcaccgcttgctgcgcaaaggcaactacgcggagcgggtcggggcaggcgccccggtgtacctggcggcggtcctcgagtacctgaccgcggaaattctggagctggcgggcaacgcggctcgggacaacaagaagacgcgcatcatccctcgccatctgcaactagccgtgaggaatgacgaagagctcaacaagttactcgggggtgtcaccattgcccagggcggcgtcttgcccaatatccaggctgtcctgttgcccaagaaaacggagagtcacaagcctggcaagaacaagtaa

SEQ ID NO: 140983 - DNA, 390 bp, Homo sapiens
  Payload ID: 7700
  Gene Symbol: HIST2H2AC
  Gene Name: histone cluster 2, H2ac
  Uniprot ID: Q16777
  ENST ID: ENST00000331380
  CDS Start-End: 1-390
atgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggccggcgcgcccgtctacatggcggcggtcctcgagtacctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgttttgcctaacatccaggccgttctgttaccaaagaaaaccgaaagccacaaagccaaaagcaaataa

SEQ ID NO: 140984 - DNA, 2194 bp, Homo sapiens
  Payload ID: 7701
  Gene Symbol: HIST2H2BE
  Gene Name: histone cluster 2, H2be
  Uniprot ID: Q16778
  ENST ID: ENST00000369155
  CDS Start-End: 13-393
ctgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaaa

SEQ ID NO: 140985 - DNA, 444 bp, Homo sapiens
  Payload ID: 7701
  Gene Symbol: HIST2H2BE
  Gene Name: histone cluster 2, H2be
  Uniprot ID: Q16778
  ENST ID: ENST00000369160
  CDS Start-End: 2-379
catgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagcgtctcgaaggggcacctgtgaactcaaaaggctcttttcagagccacccacgttttcaaataaa

SEQ ID NO: 140986 - DNA, 1954 bp, Homo sapiens
  Payload ID: 7702
  Gene Symbol: HIST2H2BF
  Gene Name: histone cluster 2, H2bf
  Uniprot ID: Q5QNW6
  ENST ID: ENST00000369167
  CDS Start-End: 37-417
cttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtccagtcttactgagttgcttgttatctgtgctacgagattcgaaaggtttgactcgttctgggatatttgggagggatggagggaaggaggcggggggtggttctacaccccttcggcctttaacctgtatctttaaagtcgttttcctttttgtttctgaaagtaatgaacgagatgagatttcccatacagatgagaaaccctcggtccgacctcttactatttcttagtgttttaatctgttttccttaccatatacctacaggcgtctgtcacaaactttgtctaatatagccatgtgctttcgtcccttagcctttttgcaagtcctgacttagccatcctcccctaacttccattccagtgacttcaaacagggagatatattgccaccaccccaccccctgtggagtatttggcaatatctgtagatgttttgggttgtcaggtgtgtgtgtgttgcgggggaggtgctagaagtatccaatgggcagaggccaggagtgctaagcataaggcacaggacagtcctctggggggacaaagagctacctggcctgtaatgtcgatctttggtgattgagagaccccagcgcccaaagacatccctaaccttcaggatttaatcctcttcagtcaaacgtttccttaaccctatcagcccatgtttttcttttcttggtgaaagctgagcacttcataggctgtttacaggtccttctccacaggaaaatacttcctccaggacaagaaccctgtcttggttccaaactttcccaattataagagtcacctttgcgcttgttaaacctgcttccaggtgcttctcctgaggtttcctgattcagctagactggaggtgggacctgacgaggtggttggtttttagtgttctcaggagtgtggatgttttaataggtgttgggtcctcatgttaatcgacctgtgggtgtgtcacagtctttgtgtcacagatgtcctgagaaaggaaacaatttgaggatgagtggaggggaatttgtggtgtagagaaggccacagttaatatgtggggtgaatttctgaagacctctcagttcaaaacttgaataactcaagactcatcctgacaaaagccagtggatgtttcttttgccaaataaaatatacccttggtgcaactggaaaatcttagcttataattaacttgacagcctttgaaattaagccattcttgataaatcttgggggaattaacaactttgtgcttaaaatgaattttactaatttttatgatgttgaaattcaaatttacacccaattaaaagatataaaatgcggta

SEQ ID NO: 140987 - DNA, 999 bp, Homo sapiens
  Payload ID: 7702
  Gene Symbol: HIST2H2BF
  Gene Name: histone cluster 2, H2bf
  Uniprot ID: Q5QNW6
  ENST ID: ENST00000545683
  CDS Start-End: 51-455
ggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagttaataggacccatcctttggaagtaggaaagtggcatagaaggagaagctgagttagagatcactcacccacttgcccatcaactggaactgcaagagatcagagaataaagatatcagttggtccaaggaaaataatgaggaagagagaattggggagacagaattaatgtagactctgagggatcaactcagatctcttgagtttctatttctctttctcaaaatccagtactaacagaactgaacaagctacaggtggttatcaaggaaacttcactgcggtgcgtccaggcttaatgctacctcagggttgcccttcccatccttttcataaaataagctctaataaaccatggaagcacagatacaagttgcttcatactcatgagttctacccagagttaccacaggaagacaaaactcttgactcacaacagccacagcctgtacccttctaactgtcccctctgagtccaacttaccccaaaggagcagagttgtcaagaaccacatgttgtctccaagctggtgggagcagtgaaatctgtaacatgcaagatattgaaga

SEQ ID NO: 140988 - DNA, 411 bp, Homo sapiens
  Payload ID: 7703
  Gene Symbol: HIST2H3PS2
  Gene Name: histone cluster 2, H3, pseudogene 2
  ENST ID: ENST00000392948
  CDS Start-End: 1-411
atggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctatcagaagtctacggagctgctgatccgcaagctgcccttccagcggctggtacgcgagatcgcgcaggagtttaagacggacctgcgcttccagagctcggccgtgatggcgctgcaggaggccagagaggcctacctggtggggctgttcgaagacacgaacctgtgcgccatccatgccaagcgcgtgaccatcatgcccaaggacatccagttggtcagccgcatccgcggggagcgggcctaa

SEQ ID NO: 140989 - DNA, 1656 bp, Homo sapiens
  Payload ID: 7704
  Gene Symbol: HIST2H3A
  Gene Name: histone cluster 2, H3a
  Uniprot ID: Q71DI3
  ENST ID: ENST00000403683
  CDS Start-End: 37-447
cgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagct

SEQ ID NO: 140990 - DNA, 1656 bp, Homo sapiens; identical to SEQ ID NO: 140989
  Payload ID: 7705
  Gene Symbol: HIST2H3C
  Gene Name: histone cluster 2, H3c
  Uniprot ID: Q71DI3
  ENST ID: ENST00000369158
  CDS Start-End: 37-447

SEQ ID NO: 140991 - DNA, 411 bp, Homo sapiens
  Payload ID: 7706
  Gene Symbol: HIST2H3D
  Gene Name: histone cluster 2, H3d
  Uniprot ID: Q71DI3
  ENST ID: ENST00000331491
  CDS Start-End: 1-411
atggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctaccagaagtctacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccatgccaagcgcgtgaccatcatgcccaaggacatccagttggcccgccgcatccgcggggagcgggcctaa

SEQ ID NO: 140992 - DNA, 583 bp, Homo sapiens
  Payload ID: 7707
  Gene Symbol: HIST2H4A
  Gene Name: histone cluster 2, H4a
  Uniprot ID: P62805
  ENST ID: ENST00000578186
  CDS Start-End: 27-338
aagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttt

SEQ ID NO: 140993 - DNA, 942 bp, Homo sapiens
  Payload ID: 7707
  Gene Symbol: HIST2H4A
  Gene Name: histone cluster 2, H4a
  Uniprot ID: P62805
  ENST ID: ENST00000614272
  CDS Start-End: 16-327
cgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtc

SEQ ID NO: 140994 - DNA, 1547 bp, Homo sapiens
  Payload ID: 7707
  Gene Symbol: HIST2H4A
  Gene Name: histone cluster 2, H4a
  Uniprot ID: P62805
  ENST ID: ENST00000618193
  CDS Start-End: 18-329
atcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacata

SEQ ID NO: 140995 - DNA, 610 bp, Homo sapiens
  Payload ID: 7707
  Gene Symbol: HIST2H4A
  Gene Name: histone cluster 2, H4a
  Uniprot ID: P62805
  ENST ID: ENST00000613412
  CDS Start-End: 8-319
agcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaagatcgctgcagtgaatgcttttaacctgtcaactgtgatgaaacaaacagaaaaccgaagccctggcttcttctgaggtgcaaataaatgaccgagaaggtgttatctaagacctctacagccatttgtatctggccgtgtgtagagtgggctctgcaagaccctgcctcactt

SEQ ID NO: 140996 - DNA, 1132 bp, Homo sapiens
  Payload ID: 7708
  Gene Symbol: HIST2H4B
  Gene Name: histone cluster 2, H4b
  Uniprot ID: P62805
  ENST ID: ENST00000579512
  CDS Start-End: 80-391
aatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaag

SEQ ID NO: 140997 - DNA, 610 bp, Homo sapiens; identical to SEQ ID NO: 140995
  Payload ID: 7708
  Gene Symbol: HIST2H4B
  Gene Name: histone cluster 2, H4b
  Uniprot ID: P62805
  ENST ID: ENST00000621520
  CDS Start-End: 8-319

SEQ ID NO: 140998 - DNA, 1694 bp, Homo sapiens
  Payload ID: 7708
  Gene Symbol: HIST2H4B
  Gene Name: histone cluster 2, H4b
  Uniprot ID: P62805
  ENST ID: ENST00000612061
  CDS Start-End: 18-329
atcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaagtatcatttcttgtgttcaataaaaagcctcctaatttaatcaaggacctatgagataactgtcttttagttgtggcattgcaaggatacaaatgcagagatattttaaagtgatccttctgtaagagtgaaccaacgatatgatctgaaagcaacttcacaggtaattcaggcttatgattttactgtgtatgtatttgggagaagaaattctgtcagctcccaaaggataaaccagcagttgctttattggtcttcagatgtggctgcaaacacttgagactgaactaagcttaaaacacggtacttagcaatcgggttgccagcaaagcactggatgcaagccttgccttccagaagcttaccagtcgggttgccagcaaagcagtggatgcaagacttgccctccaggagcttaccatcacaacgaagaagacaaataaatgcataatatatagacgacataaatccatactgtacacatttaagaataaacagtccagtagtaagaggcagtacatattcaatctgctgagaaatgtagacaataactactataagaatcctaatgctacagaagtcactggctgctgggaaaccggggaaaacttggctatggacgtgggggcttgtgtcggactctgaataaagagcagaatgattggcgtc

SEQ ID NO: 140999 - DNA, 895 bp, Homo sapiens
  Payload ID: 7709
  Gene Symbol: HIST3H2A
  Gene Name: histone cluster 3, H2a
  Uniprot ID: Q7L7L0
  ENST ID: ENST00000366695
  CDS Start-End: 57-449
ctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctactatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaa

SEQ ID NO: 141000 - DNA, 2364 bp, Homo sapiens
  Payload ID: 7710
  Gene Symbol: HIST3H2BB
  Gene Name: histone cluster 3, H2bb
  Uniprot ID: Q8N257
  ENST ID: ENST00000620438
  CDS Start-End: 24-404
ctgtttggagagactcagccatcatgccagacccgtccaaatcggctcctgcgcccaagaagggttctaaaaaggctgtcaccaaggcacagaagaaggacggcaagaagcgcaagcgcggccgcaaggagagctattctatctacgtgtacaaggtgctgaagcaggtgcaccccgacaccggcatctcgtccaaggccatgggcatcatgaactccttcgtcaatgacatcttcgagcgcatcgccagcgaggcctcccgcctggcacactacaacaagcgctccaccatcacgtcccgcgaagtgcagacggccgttcgcctgctgctgcccggcgagctggccaagcacgccgtgtccgagggcaccaaggctgtcaccaagtacaccagctccaagtgaggcgttcctcggcgtcctgaacccaaaggctcttttcagagccacccacacgatcaagaaagggtttcgaacacggtgaagggttatgtaacctaatgtgtctccatgcaccctagcggttgccgggtgcggccgaatctgagccgtgtgtgtgtgtgtgtgtgtgtgtgtgtgcgcgcgcgcgccggcacagaacgagaaaaactgctcgttacagaaatcggggtagaaactgctcaggtgatgtagctcagtaatgttgggaggcgatcaaggaccccctctccatcccctccctccgcgcagagctattaactcacgacgagatttcttttttttttctttctttctttttttttttttttttttctagaagaagtctcgctctgtctctaggctggcgtgcagtggcgcaatctgggctcactgcaacctccgcctcctgggttcaagcgattctcctgcctcagccttacgagtagctgggattacaggcacgccccaccacgcctggctaattttttgtatttttagtagagacggggtttcaccatgttggccaggatagtctcgatcttctgacctggtgatccatccgcctctgcctcccaaagtgctgggattacaggcgtgaaccaccgcacctggccccaaatgtcttttataagcaagtggtgcattcctggatgttgagcgcttgcgcccggttcaggaccgggtccaaatgaggttggcgtgcgccgtgcaggtgaggagtgcgggtcacctccccccaaaagaccctgtgccaacctccccaaccctacccgccccccatgggcgaggccagacgtggcgcaagaccacgggctctgaggccatgggtgttgtcactttcccctggcggtggtgcctggctctgcatttgcttaagacttttccatccctgcctggaccagacagacatgtttagatttaagcaatgaacattccgggaggatattttcctggcaggataccgcgatggcaggatgtttgataccgaatcgaagcacggcgtcaaagcagcgtcctgcgcgggggagccggatgtaataagcgaccccagctgccggtaactttaacccttatgggagtgggggtgggggaaggggttaatttaggaggaaaagaattccctttttctgagcaaatgtagctgcctccctctttagccacattattttctgcgaggcgttagcaacgcagaattcctttcctaccccctccaaattcacggcatttatttggggagtgccattttggcgcaggaaagctctttggcacgaagagttttcactttggaaagggcatcgtttacgttttcatgacttggcttttcttctttagaaaaagaagatttccagtaattgcttcctcaaaccgttgtgaaaattcgaagtactgagcgtttgtgtcaccatttccagcagggaataaaaattcaataaagttaaatgagaaataattttttttttttttgagacggagtcttgctctgtcgcccaggctggagtgcaatggcgcgatctctgctcactgcaacatcggcctcccgggttcaagcgattctcctgcctcagcctcccgagtagctgggactacaggcgtgcgccacccacgcccagctaatttttttaatttttagtagagacggggtttcaccatgttggccaggatggtctcgatctcttgacctcgtgatccaccctcctcggcctcccaaagtgctgggattacaggcgtgagccacttctcctggccgagaaataatttttaaataaaattcaatgaaaaatatttttcccccaagtcatttctccaaagggaacccgtcgcgtgcctgggatggggaaagaaaggtcaccgtgaacatcctcgaccaaaacggctttgtcccctattccccaccttttttttcctgcgtgattcctctacaaga

SEQ ID NO: 141001 - DNA, 481 bp, Homo sapiens
  Payload ID: 7711
  Gene Symbol: HIST3H3
  Gene Name: histone cluster 3, H3
  Uniprot ID: Q16695
  ENST ID: ENST00000366696
  CDS Start-End: 1-411
atggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatccgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctaggagggctatctcgccacctgagaggttgcgcaacgttcaccccaaaggctcttttaagagccacccacct

SEQ ID NO: 141002 - DNA, 1918 bp, Homo sapiens
  Payload ID: 7712
  Gene Symbol: HIST4H4
  Gene Name: histone cluster 4, H4
  Uniprot ID: P62805
  ENST ID: ENST00000358064
  CDS Start-End: 48-359
acagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacggaccaagtctagctctgccaccgaggctggagtgcagtggcacgatctcgcctccgcctcccgggttcaagcgattcacctgcctcagcttccggagtagctgggattacaggcctgcgccaccacgcctggctaatttttgtattttttttttttttggtagatacggggtttcaccatgttggccaggctggtcttgaactcctggcctcaagtgattcacccgcctccgcctcccaaagtgctggcatttcaggcgtgagccaccacgcttggtcttgctctagctattctaaacatgaagaagtcatatagcttccttggtgcggtgggctgaagtcactctaagggagtttcccagccccaggggttaaagaactggagtcaagattggaacccagctggcgaaggattccgcaccgctagatcttgacatttgcctcttcttctgccaggaaggctcccctgttcctttttgctgacgtgtcatttctaagtactttctcctactccataaagacttcaagtgagtacacaatactggtgttagtttaatttctaagacagtgagacactcggagaagttcaattttctttaatgcaagtgaaaaattgagttacttaaaagaaatagagtctggcatactttcgtgccctcgatatttgttgcatgaccaaatgagtgattttgggtttcacataaattaaggatgaaagttagggccccgatggaggatagaaatactgtagatatttgtatgacaattaaaactcttccttaagtatttaacttatatggaattgtttaaatatttcatggttttggggtttttttttatttttgtagtggtctcaattctttgattagaatagaacttatattttcccttgtagcatagttatttttttgtttgtgttttgttctttataaaatataacctaattatctaaacccaagaaatatttatttttgtctgtgactctgagtcctatggtatagtaagtacccagtcctgacagtaatcatatcttccaaaccaaaactgggtcacacggttcaataactgaacagaatatctcaaactgaaaacgatcaagattttctgaagtttactattaatagtaaaattgcttactaaaaatgttaaagaacttgatttaaaactctgtaatgcctcacttaaaatgtgaatgaggggggcggggtgggggtggctataatgccagcactttgggaaggctgaggcagtaggattgctggaggccaggagtttgagaccagcatggccaacatagtgagaccccatctctacataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgcca

SEQ ID NO: 141003 - DNA, 577 bp, Homo sapiens
  Payload ID: 7712
  Gene Symbol: HIST4H4
  Gene Name: histone cluster 4, H4
  Uniprot ID: P62805
  ENST ID: ENST00000539745
  CDS Start-End: 48-359
acagtgggcagcccgattttctgctgagtaggcgctgtgatttcagaatgtctgggcgaggtaaaggtggcaaggggctgggtaagggaggcgccaagcgccaccggaaggtgctgcgggacaatatccaaggcattacaaagccggcgattcgccgtctcgcccgacgtgggggcgtcaagcgcatttctggtctcatctacgaggagacccggggagtcctcaaagtcttcctggagaacgtgatccgtgacgcggtgacttacacggagcacgccaagcgcaagaccgtcacggccatggatgtggtgtacgcgctgaaacgccagggtcgcaccctttatggtttcggcggttgagctgtccccacagcttctctacagactccaaaaggcccttttcagggcccccaaactgtcacagaaagagctgttaacacttcctagataacgggtaaatatcaaccctttgatgtcgccttccggataccggaaatgggatattcgcggcccgagcatctgctcgggattagacttggcgggcacggggagaactagacctcaaggagggggttccg

SEQ ID NO: 141004 - DNA, 2124 bp, Homo sapiens
  Payload ID: 7713
  Gene Symbol: HDAC1
  Gene Name: histone deacetylase 1
  Uniprot ID: Q13547
  ENST ID: ENST00000373548
  CDS Start-End: 85-1533
ctcccccctgggtcggacgctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgccatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctatatcctcctga

SEQ ID NO: 141005 - DNA, 664 bp, Homo sapiens
  Payload ID: 7713
  Gene Symbol: HDAC1
  Gene Name: histone deacetylase 1
  ENST ID: ENST00000428704
  CDS Start-End: 31-664
gactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagatcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcct

SEQ ID NO: 141006 - DNA, 2687 bp, Homo sapiens
  Payload ID: 7714
  Gene Symbol: HDAC10
  Gene Name: histone deacetylase 10
  Uniprot ID: Q969S8
  ENST ID: ENST00000216271
  CDS Start-End: 354-2363
ggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacgaaa

SEQ ID NO: 141007 - DNA, 1950 bp, Homo sapiens
  Payload ID: 7714
  Gene Symbol: HDAC10
  Gene Name: histone deacetylase 10
  Uniprot ID: Q969S8
  ENST ID: ENST00000349505
  CDS Start-End: 1-1950
atggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttga

SEQ ID NO: 141008 - DNA, 2375 bp, Homo sapiens
  Payload ID: 7714
  Gene Symbol: HDAC10
  Gene Name: histone deacetylase 10
  ENST ID: ENST00000415993
  CDS Start-End: 230-520
gcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacagcgctgtctgtacccaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacgaaa

SEQ ID NO: 141009 - DNA, 2133 bp, Homo sapiens
  Payload ID: 7714
  Gene Symbol: HDAC10
  Gene Name: histone deacetylase 10
  ENST ID: ENST00000448072
  CDS Start-End: 209-2068
ctgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgc

SEQ ID NO: 141010 - DNA, 1922 bp, Homo sapiens
  Payload ID: 7714
  Gene Symbol: HDAC10
  Gene Name: histone deacetylase 10
  Uniprot ID: Q969S8
  ENST ID: ENST00000454936
  CDS Start-End: 1-1191
atggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggaggtaagctgggcagggtggaggtgctgcggggtgggacgagggaaaggaccagtgactgcttccgtcttcgcccctggtccagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgc

SEQ ID NO: 141011 - DNA, 1634 bp, Homo sapiens
  Payload ID: 7714
  Gene Symbol: HDAC10
  Gene Name: histone deacetylase 10
  ENST ID: ENST00000429374
  CDS Start-End: 48-338
accactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctgg

SEQ ID NO: 141012 - DNA, 2607 bp, Homo sapiens
  Payload ID: 7714
  Gene Symbol: HDAC10
  Gene Name: histone deacetylase 10
  ENST ID: ENST00000626012
  CDS Start-End: 374-664
gcgcagctccgagggctggcggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacg

SEQ ID NO: 141013 - DNA, 2960 bp, Homo sapiens
  Payload ID: 7715
  Gene Symbol: HDAC11
  Gene Name: histone deacetylase 11
  Uniprot ID: Q96DB2
  ENST ID: ENST00000295757
  CDS Start-End: 184-1227
ggccttcctgcgggcaggctctctgtgtcgcaacactggcggggcgggccaaatcggccagagctctgcccccagaggacgcggctaagcccgggggcgtgtcctgggctggccccacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 141014 - DNA, 576 bp, Homo sapiens
  Payload ID: 7715
  Gene Symbol: HDAC11
  Gene Name: histone deacetylase 11
  ENST ID: ENST00000405025
  CDS Start-End: 154-510
gtgggctcccaggggtcccggtgggcgggcgcgctagggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcag

SEQ ID NO: 141015 - DNA, 1018 bp, Homo sapiens
  Payload ID: 7715
  Gene Symbol: HDAC11
  Gene Name: histone deacetylase 11
  ENST ID: ENST00000402271
  CDS Start-End: 46-852
cccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaa

SEQ ID NO: 141016 - DNA, 1000 bp, Homo sapiens
  Payload ID: 7715
  Gene Symbol: HDAC11
  Gene Name: histone deacetylase 11
  ENST ID: ENST00000402259
  CDS Start-End: 67-612
cccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctcc

SEQ ID NO: 141017 - DNA, 799 bp, Homo sapiens
  Payload ID: 7715
  Gene Symbol: HDAC11
  Gene Name: histone deacetylase 11
  ENST ID: ENST00000405478
  CDS Start-End: 186-799
cgggatgtgagtgccgcggggcgagggcgggggtgggctcccaggggtcccggtgggcgggcgcgctagggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatga

SEQ ID NO: 141018 - DNA, 967 bp, Homo sapiens
  Payload ID: 7715
  Gene Symbol: HDAC11
  Gene Name: histone deacetylase 11
  ENST ID: ENST00000404040
  CDS Start-End: 25-768
agctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtggggg

SEQ ID NO: 141019 - DNA, 577 bp, Homo sapiens
  Payload ID: 7715
  Gene Symbol: HDAC11
  Gene Name: histone deacetylase 11
  ENST ID: ENST00000404548
  CDS Start-End: 25-465
agctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatact

SEQ ID NO: 141020 - DNA, 2766 bp, Homo sapiens
  Payload ID: 7715
  Gene Symbol: HDAC11
  Gene Name: histone deacetylase 11
  ENST ID: ENST00000437379
  CDS Start-End: 83-1042
gctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgt

SEQ ID NO: 141021 - DNA, 731 bp, Homo sapiens
  Payload ID: 7715
  Gene Symbol: HDAC11
  Gene Name: histone deacetylase 11
  ENST ID: ENST00000455904
  CDS Start-End: 234-731
ttaagcagctgttgttgaggggcccttgtctgcggctgaggggctagtggtgctgggcaatggctggtgggtcagtccaggcgggctcgggagggagctgctttctgccgaggctgccccagctgtgcgtctgtctttttccacacggtaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggac

SEQ ID NO: 141022 - DNA, 520 bp, Homo sapiens
  Payload ID: 7715
  Gene Symbol: HDAC11
  Gene Name: histone deacetylase 11
  ENST ID: ENST00000434848
  CDS Start-End: 16-520
gactgccagggtgtgatgggaagggttagcagcgcagcggggtcaggggatccccgccccccgccctggctcaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgt

SEQ ID NO: 141023 - DNA, 1021 bp, Homo sapiens
  Payload ID: 7715
  Gene Symbol: HDAC11
  Gene Name: histone deacetylase 11
  ENST ID: ENST00000425430
  CDS Start-End: 43-204
ggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagtt

SEQ ID NO: 141024 - DNA, 2875 bp, Homo sapiens
  Payload ID: 7715
  Gene Symbol: HDAC11
  Gene Name: histone deacetylase 11
  ENST ID: ENST00000446613
  CDS Start-End: 218-928
aaatcggccagagctctgcccccagaggacgcggctaagcccgggggcgtgtcctgggctggccccacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatgggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttcatcttctga

SEQ ID NO: 141025 - DNA, 580 bp, Homo sapiens
  Payload ID: 7715
  Gene Symbol: HDAC11
  Gene Name: histone deacetylase 11
  ENST ID: ENST00000416248
  CDS Start-End: 306-580
gagtgcttactgtgctcagctcctcagttgcattctctgagtcctcacaacagccacacattttgcagccgaagccttgtgccacacagctgtgggggcatttattacggtgcagaggtgatgcgcggaggccttgcagccagacacacctgagtgcacgcctgcttctccacagacctgcactgtgaccttgggcacacctggtctgctctctgagcctctggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggagg

SEQ ID NO: 141026 - DNA, 580 bp, Homo sapiens
  Payload ID: 7715
  Gene Symbol: HDAC11
  Gene Name: histone deacetylase 11
  ENST ID: ENST00000418189
  CDS Start-End: 259-580
agatttgctggtgaggggtgagggacgctcgggacgggtgtttccaggccctcccggcgcgccaggccagccccgcgcccctgctcggtggcccgagggacgcgcgccggccgcgggcctgggcccggacccggagcggtcgggcgatgtgcgcgggtctgacgtctgcgctgcccagccccctggctacgcggacgcccccacggaggcagccactggggcggatttctgtctctgggtgacgactgccagggtgtgatgggaagggttagcagcgcagcggggtcaggggatccccgccccccgccctggctcaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctg

SEQ ID NO: 141027 - DNA, 2043 bp, Homo sapiens
  Payload ID: 7715
  Gene Symbol: HDAC11
  Gene Name: histone deacetylase 11
  ENST ID: ENST00000433119
  CDS Start-End: 476-1186
gcaggctctgagagcctacatgtcttcgccgggagtgcttgtcccggagctgctcgcagactgggccgggggtgggctcgggtcggagaggtcacggggctccttaggtcacaggcggcagggccagagaaactcccccgcccctacgtttaactcgcggaaacaagggcccagagagcccagacgccagcccaaggtcacacagcgaagccccggcacagcccgccgggaacctgtcgtttctaacccccagcctctcgccgtttctacccagcttgggaagcgcaggaacaggacatacggtggtcgcgccccttccgcgaggccggggtgaaacccgcttggccctcccgccagggggcggagcttccgaaccaggcgggattccaccgggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatgggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgc

SEQ ID NO: 141028 - DNA, 1559 bp, Homo sapiens
  Payload ID: 7715
  Gene Symbol: HDAC11
  Gene Name: histone deacetylase 11
  Uniprot ID: Q96DB2
  ENST ID: ENST00000522202
  CDS Start-End: 119-1009
agggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagca

SEQ ID NO: 141029 - DNA, 2084 bp, Homo sapiens
  Payload ID: 7716
  Gene Symbol: HDAC2
  Gene Name: histone deacetylase 2
  Uniprot ID: Q92769
  ENST ID: ENST00000368632
  CDS Start-End: 368-1744
tttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacgccttcaccctgccatttctagtgaatctgtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgg

SEQ ID NO: 141030 - DNA, 553 bp, Homo sapiens
  Payload ID: 7716
  Gene Symbol: HDAC2
  Gene Name: histone deacetylase 2
  ENST ID: ENST00000425835
  CDS Start-End: 1-486
aaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattgatactcttttcagtgataaagtgttttcattaaaacacaataaataaagtctatggctttaaaaaata

SEQ ID NO: 141031 - DNA, 549 bp, Homo sapiens
  Payload ID: 7716
  Gene Symbol: HDAC2
  Gene Name: histone deacetylase 2
  ENST ID: ENST00000523628
  CDS Start-End: 240-549
attttgcagagattattaatgtttatattatgctaattattaatatgtgatagtgtgctgacctcatccaaaaacttatatttttattaccagagaacattgttttgtcagcttacaaaagtagcaatactaattctttttttattgtgagaagagaatgcaaggaaaggagcttctgtatcaaagaatcgtgactttaaggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctg

SEQ ID NO: 141032 - DNA, 557 bp, Homo sapiens
  Payload ID: 7716
  Gene Symbol: HDAC2
  Gene Name: histone deacetylase 2
  ENST ID: ENST00000521163
  CDS Start-End: 230-557
gagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacgtttgtgtcttttctattttaggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccag

SEQ ID NO: 141033 - DNA, 502 bp, Homo sapiens
  Payload ID: 7716
  Gene Symbol: HDAC2
  Gene Name: histone deacetylase 2
  ENST ID: ENST00000522371
  CDS Start-End: 245-502
accctatgctcaggcccgctcccacactgtggagtgtaccttcattttcaataaatctcttcattccctccttgctttgtgcatttcgtccaattctttgttcaagatgccaagaacctggacaccctccactggtaacgtattttgatgagccagtcaggagaaattccaggagaagccttcaccctgccatttctagtgaatctgtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggc

SEQ ID NO: 141034 - DNA, 564 bp, Homo sapiens
  Payload ID: 7716
  Gene Symbol: HDAC2
  Gene Name: histone deacetylase 2
  ENST ID: ENST00000518690
  CDS Start-End: 352-564
aacccgttcccggcccggcacagttagaacgagaccctcttcctggcgcagcccccgcggttcctgcgggcgggaatcagggggcccgcccgtcttgtctcctgcctctcccccttcggccgtgcagtccgcagcctcgaaggtggccgccgctggggacggcgccggcctaccccgccttggtggtggcggcggcgaagggggcggcccattctctcccttctcccgcccaccattcgtggcaacgcagcccattcacctgcttacgtgatggccagcaacaagtgaatagctgatagtttggaaatctctggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgt

SEQ ID NO: 141035 - DNA, 551 bp, Homo sapiens
  Payload ID: 7716
  Gene Symbol: HDAC2
  Gene Name: histone deacetylase 2
  ENST ID: ENST00000520895
  CDS Start-End: 372-551
gctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacgcccattcacctgcttacgtgatggccagcaacaagtgaatagctgatagtttggaaatctctggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaag

SEQ ID NO: 141036 - DNA, 570 bp, Homo sapiens
  Payload ID: 7716
  Gene Symbol: HDAC2
  Gene Name: histone deacetylase 2
  ENST ID: ENST00000524334
  CDS Start-End: 413-570
gcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacgcccattcacctgcttacgtgatggccagcaacaagtgaatagctgatagtttggaaatctctgccttcaccctgccatttctagtgaatctgtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccaga

SEQ ID NO: 141037 - DNA, 557 bp, Homo sapiens
  Payload ID: 7716
  Gene Symbol: HDAC2
  Gene Name: histone deacetylase 2
  ENST ID: ENST00000523240
  CDS Start-End: 361-557
acagttagaacgagaccctcttcctggcgcagcccccgcggttcctgcgggcgggaatcagggggcccgcccgtcttgtctcctgcctctcccccttcggccgtgcagtccgcagcctcgaaggtggccgccgctggggacggcgccggcctaccccgccttggtggtggcggcggcgaagggggcggcccattctctcccttctcccgcccaccattcgtggcaacgcagcccattcacctgcttacgtgatggccagcaacaagtgaatagctgatagtttggaaatctctgccttcaccctgccatttctagtgaatctgtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaa

SEQ ID NO: 141038 - DNA, 580 bp, Homo sapiens
  Payload ID: 7716
  Gene Symbol: HDAC2
  Gene Name: histone deacetylase 2
  ENST ID: ENST00000521610
  CDS Start-End: 280-580
attcgtggcaacgcaggtttggggtgccccgcgtcggcctcctaccccctcgacccgtcccccgcgaggcaaaatttctatcccggccttgactctacacaaagccccgcggccgcgagagctccgcccctcccgtccccttccctcctcctcgcctgctcgcctcccctaccctgcgttcggtctggccggagcgtcttctccttcctcggcttaccctttccccggacccctcctcccggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactg

SEQ ID NO: 141039 - DNA, 2000 bp, Homo sapiens
  Payload ID: 7716
  Gene Symbol: HDAC2
  Gene Name: histone deacetylase 2
  Uniprot ID: Q92769
  ENST ID: ENST00000519108
  CDS Start-End: 284-1660
gttcccggcccggcacagttagaacgagaccctcttcctggcgcagcccccgcggttcctgcgggcgggaatcagggggcccgcccgtcttgtctcctgcctctcccccttcggccgtgcagtccgcagcctcgaaggtggccgccgctggggacggcgccggcctaccccgccttggtggtggcggcggcgaagggggcggcccattctctcccttctcccgcccaccattcgtggcaacgcaggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgg

SEQ ID NO: 141040 - DNA, 9874 bp, Homo sapiens
  Payload ID: 7716
  Gene Symbol: HDAC2
  Gene Name: histone deacetylase 2
  Uniprot ID: Q92769
  ENST ID: ENST00000519065
  CDS Start-End: 378-1844
gcaggttgttcaccctaacagggcctctaacctcgagcccgaaacggcctccttctccagccgtgccccttcctcccccgtggaggccgcagtggatgcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggattgaagaaggcctaagtgtgacaccaaactcaactataaaagatatatttgataacaaaaaaaaaattagttcagtggaccaacaaaaacttagaagacaagtcaagaaaaatgacaaaagacagagtgggaggcagatttgtaactcatccaggtcaaaaggctcatatctaaagatagtagaggaacaaaatgtataaggatgtgaactgggaaacaaatacatataaatagtttgtaaatatgaaaagatctttaacctcagtaaataaaaagctatagagagacttattttttaacttagttttttaaacctattatgtttatttattttttctttttttgagacggagtctcgctgttgcccaggctggtgtgcaatggcgcaatctcggctcactgcaacctccgcctcccaggttgaagccattctcctgcctcagcctcctgagtagctgggattacaggcgcctgtcaccacgcccagctaattgttcgcatttttagtagagacggggtttcactatgttggccaggctggcctcgaactcctgacctcatgatccacccaccttggccttccaaagtgctgggattacaggtgtgagctgccgcacctggctgtttatctcttttttttagagaaaggatctcggtcacccaggatggagtgtggtagcctgatcatatctcactacatcttagaacttctaggcttagggtattctcccacctcagcctcccaagtagctgggactacaagtgtgcaccatcacacctagctgatttttacatttttattttggagagatggtgtctccctgtgttgcccaggctggtcacaaactcctaggctcaagcgattctcctgactcaggcatgagccaccgtacccggcctaaacctatcatgttacagacttagaaagcaactattgtcaagtgtttgaggaaactcaggtcaggtttggtaaactaagatattaactcaagtaaagctctttaattcatttaatgaaggtgccacattgtctcagttctctatggcatgggtgaatgctgttctaagtcagcattggtactctaagctagttacatcatatctaagctttgcccttctaccagagctgctagcattctgtcaatgggcaattatttgaagttcttacattgaagttagtcacctacatcttctgttttttatggttttgatgtagtaatactgctgaagtttttttgataactgcgattcataatatttgttattcatattgtgatataaatgataagggcttttgaaaacaagtagtaatcatttcaatagcttaggatctccaccataatcttaggaaaattactaacctctgtgcctcagttgcttcatcatttaaaatgaggaaaataatagtccctacttaataggtttgttgtgaggattgagttaataacatagttaatgctcagtaagggttagctgctatttttttttcttttttttttgaaagagtctcactctgttgcccaggttggagtgcagtggcatgatcttggctcactgcatcctctgcttcctaggttcaggtgattctcatgcttcagcctcccaagcagctgggagtacaggtgtgcaccaccacacctggctaatttttgtatatttagtagagacgggttctcaccatattgtccaggctggtcttgaactccttacctcaaatgatccacccgcctgggcctcccaaagtgctgggattacaagcatgagccaccgcgcctggcttgctattgttatgaggtaaaggtagatagatgggtgagagtggtgccaggggaagtgttaaatttttgagtgttcctttagatgccagatgggttgtatctgagccttttattgcagtttgatgcctactagtgtgaagactactaggtcatagtggatagagaagcaatcttttggagacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaattaagtttactgatttaggttttcctataagaattataacactaatttctaagttttacatctgcaaaacacagtagagtgtatctggtagtcattgactaattgtgactttgctagtcagacaaaatggaactgaatattagagccagaataattttctgttttgactggtggtaagaatcagttagtatacagaatgggaaagaattgaaatttatttctaggaattatagttatagtgaagttaatattcaggggcattgggtgcttgttccacgacttttgtttactgaactaagtacctaacccctttggtctttgaacactgcagagttatgattaggattattaatgaaaaattcttttttagtagaacaaacagttaaggacagaagacaccttgattagattctgttatttgctctttttattaagattgtttttactctaaatgttaaagaaatgtataattatttctaaggtaaaatgagtagcaggattctgaataggagattttttttggccagacccattttgcagccagtggtttgtatttaggagtgagttgaacaaagaagactctaatctgtttttgtgttgtggattttttattctattgataaatcagtagcttccagcttctcttgtatcctctactagtcatcttttttgtttcttcagaaataaacatccagggtcacttccctgcccttgccatatacttactaggatgatgtacaggtaaaacttttaaaggaaagtacggacaggcaattcctaaagtaaaagagagcacattatcaaaactggctgtacttaacaaataccaacaaaaagtcattacacttctggcaacaaataatgtttgatttaaaaagacaagaatttccccttttgctcttattttttaaatatgctatgtccttaagtgagaaatgcacttcaaaaattttcttattctgaagtctagccggaaagtttgaacttgtgttgcctttggctagactaggtgaaattaaggggcttaagagggcactgttgtgtggccctgtggtagataatagccctccaagcatgaggatgggagatctaccattcaccagtatttccaaagttatattcttaaaaaggctagatttctaatttccgtagaatctaggtatgttcttttcaactcagcatctgataagaaagtttgggcaagtaggtgcgaaaaatttactctagataccattttccaggaaaaaatataattcaagtccaacgtattactagctgtcaccttccccaacaatcaaataagcattgttattgtcaaacacatttacttgtatagttcagtgttatatgtaatggacttaggtataattcctgtgctattcccttttgatgccaaacacccttttgtaagctgttttgtttgaaatccaaatttatatgtcttaaagtaaatggcagcattgggctttcttaatgtaatgactcttctgccatcctatttctagagttaggcagaaaattctgtaaatctatcttatttccagtctgtttgtgactatggtgggcaataaatctgatttcccagaaaaacacatctggacccctataggtaaggtaaacaagcctcatcttaaattgtttgtacttccgacctgacctcaaaacaccatcatcatctagagcagcaacaagtaaagaacaatgcactggaaatcacatatatgggtctagcaccagcctttacattacacaactttgctttgggcaagtcatttaaatttctgtgcttcagtttactaaatctatgaaactgactaggtaacagctgacatgcttttccagcactccgtcttttacctgtctgatgtcacaaattgatcattcctttctggccttgagatgcgtatcaacccagatagtcattaacccagatagttggcattcaggataaaatgtttttgcctttcctgtcctgcaagctctttaaagtccaaaatatgcctttatatctttatgtgtaataggtatgaaatctatttcttggttgttgaataggataggcttattagacattctaaagtcaacttttttctcatatttaaacatttacccgtagaaattcagttttttaaagttttaagtcagttgattgtaccaaacattactattaaaaaaaaatcaaagtcagagaccagagtttccctgcatcagcgttcagtcaggagacaggaactatactaatttgaacatgtaaagttaaatataatccttaataataacaggattggaataagggataaaagaaagagaattccttctatatatatgtatacacacacatatatatatatacatgtgtatatatgtgtgtgtatgtatattatataatatacatacacacacacaaagaatgtcagacaaggagcagccaccattctgcttactttcactggattaagagtttcataagggcaagggttttgtttgtcttacactccactggggattaatctccagtgtctagaacagtgcctaacacataaataaagcctcaattattatttgtggaatggaatggaatttgagtgaaatggaatgggaatagaatggactggaatggaaatagaagtgggaaggggaatggaaggggatagaagaggattgaagaggacagaaggagatgggataagatgggatgggataggatcgaatctcaggtccaggagtcagaataactgaatcctattccagttctgccatcaacaagtcctgtgaaatttggaaagtcacttaaccctctggccttgtagaatatctcagtgggcatgtctgatgtttcttcatggttagatataggttgcatgttttgggcaagaatatcacaggaatgatgctgtgttctcagtgcacccagtcaggtaatgcatgatttcaatttctctcattactgatgatgttaactttaatcacttagtgaatgagaacatgagcatcattttgaaagcaaactgcaaagttttgatgtcaacattttagcaattacgtataatttcccccaaggatactggctttgagataatgtaaatatacatgggaaagacaaagctcaaataaaggaaaaagaccca

SEQ ID NO: 141041 - DNA, 1959 bp, Homo sapiens
  Payload ID: 7717
  Gene Symbol: HDAC3
  Gene Name: histone deacetylase 3
  Uniprot ID: O15379
  ENST ID: ENST00000305264
  CDS Start-End: 81-1367
agcacgcacggccggggaggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccaacatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtaccttt

SEQ ID NO: 141042 - DNA, 699 bp, Homo sapiens
  Payload ID: 7717
  Gene Symbol: HDAC3
  Gene Name: histone deacetylase 3
  ENST ID: ENST00000523088
  CDS Start-End: 44-699
ggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctggg

SEQ ID NO: 141043 - DNA, 736 bp, Homo sapiens
  Payload ID: 7717
  Gene Symbol: HDAC3
  Gene Name: histone deacetylase 3
  ENST ID: ENST00000519474
  CDS Start-End: 49-210
ccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatccccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggg

SEQ ID NO: 141044 - DNA, 8976 bp, Homo sapiens
  Payload ID: 7718
  Gene Symbol: HDAC4
  Gene Name: histone deacetylase 4
  Uniprot ID: P56524
  ENST ID: ENST00000345617
  CDS Start-End: 793-4047
ggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcatagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaagaaaaagaaagcgaacagtttttgtttgttttttttgccgtgtgtgctccatagtggaggcgctattttccaattgatgagaatgacaaacatatataatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtggccaccattcacctctgtaatttaatccgtttctcttggattgtctggacgtgcccgatggttctttcttttgctcagtggagttggaggttttgtgtttggttttctcattcttgtcttgttttgtgtgggtggattttcaccgaccaatgatatcctcttctgacggtcaccttctttccacttcactggagtccagtattctgtaccacatcacgcaacgtgttatcttgtggtgtaaataaagactgcgttacttgccctccca

SEQ ID NO: 141045 - DNA, 445 bp, Homo sapiens
  Payload ID: 7718
  Gene Symbol: HDAC4
  Gene Name: histone deacetylase 4
  ENST ID: ENST00000445704
  CDS Start-End: 1-445
ggtggctttacctgttcccccaccctcctcatcctcctcactgtggctcggggctatatttgcagagtcaccacctccagcaggcgtggataccacactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcggga

SEQ ID NO: 141046 - DNA, 554 bp, Homo sapiens
  Payload ID: 7718
  Gene Symbol: HDAC4
  Gene Name: histone deacetylase 4
  ENST ID: ENST00000446876
  CDS Start-End: 186-554
gaattcttccccagcgaggccgccgggagagcaggacttgggtttctcctgagttacggcgccgaacgccctgagaaaaacgcctttggagcagtttccgggattaagcgaaagtctgggctgaagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcag

SEQ ID NO: 141047 - DNA, 565 bp, Homo sapiens
  Payload ID: 7718
  Gene Symbol: HDAC4
  Gene Name: histone deacetylase 4
  ENST ID: ENST00000454542
  CDS Start-End: 78-565
agttttcggcagagtcgcgtgtctgagaagtgacgctgggatgtccctgggctgtgccaggagcagtgctggctcagatggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactg

SEQ ID NO: 141048 - DNA, 578 bp, Homo sapiens
  Payload ID: 7718
  Gene Symbol: HDAC4
  Gene Name: histone deacetylase 4
  ENST ID: ENST00000430200
  CDS Start-End: 1-527
cggcctggccatgtgtctcgacaccccagcccccagtcttcttacgatgccatgagacgcgtttctgggctgtgctggctgcggtcctcccccgttcacactgcagtctcccgtttcccgttgcaggcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagct

SEQ ID NO: 141049 - DNA, 342 bp, Homo sapiens
  Payload ID: 7718
  Gene Symbol: HDAC4
  Gene Name: histone deacetylase 4
  ENST ID: ENST00000544989
  CDS Start-End: 254-342
gacgctggagtggggagaagcatcatggttcaacgttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccag

SEQ ID NO: 141050 - DNA, 8990 bp, Homo sapiens
  Payload ID: 7718
  Gene Symbol: HDAC4
  Gene Name: histone deacetylase 4
  Uniprot ID: P56524
  ENST ID: ENST00000543185
  CDS Start-End: 1144-4062
ggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacagactggtatctttcaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcatagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaagaaaaagaaagcgaacagtttttgtttgttttttttgccgtgtgtgctccatagtggaggcgctattttccaattgatgagaatgacaaacatatataatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtggccaccattcacctctgtaatttaatccgtttctcttggattgtctggacgtgcccgatggttctttcttttgctcagtggagttggaggttttgtgtttggttttctcattcttgtcttgttttgtgtgggtggattttcaccgaccaatgatatcctcttctgacggtcaccttctttccacttcactggagtccagtattctgtaccacatcacgcaacgtgttatcttgtggtgtaaataaagactgcgttacttgccctccc

SEQ ID NO: 141051 - DNA, 5326 bp, Homo sapiens
  Payload ID: 7719
  Gene Symbol: HDAC5
  Gene Name: histone deacetylase 5
  Uniprot ID: Q9UQL6
  ENST ID: ENST00000225983
  CDS Start-End: 325-3696
gttgttggtggcggcggcgagcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggcagatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgccttctggg

SEQ ID NO: 141052 - DNA, 5040 bp, Homo sapiens
  Payload ID: 7719
  Gene Symbol: HDAC5
  Gene Name: histone deacetylase 5
  Uniprot ID: Q9UQL6
  ENST ID: ENST00000336057
  CDS Start-End: 305-3418
gcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgc

SEQ ID NO: 141053 - DNA, 846 bp, Homo sapiens
  Payload ID: 7719
  Gene Symbol: HDAC5
  Gene Name: histone deacetylase 5
  ENST ID: ENST00000588261
  CDS Start-End: 1-846
ggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcat

SEQ ID NO: 141054 - DNA, 445 bp, Homo sapiens
  Payload ID: 7719
  Gene Symbol: HDAC5
  Gene Name: histone deacetylase 5
  ENST ID: ENST00000588703
  CDS Start-End: 208-445
ggggtctgggtctatttttagctccgggtcgggtcacgtgacgggagtgacgtctccgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcggcagatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagc

SEQ ID NO: 141055 - DNA, 504 bp, Homo sapiens
  Payload ID: 7719
  Gene Symbol: HDAC5
  Gene Name: histone deacetylase 5
  ENST ID: ENST00000587135
  CDS Start-End: 384-504
gcggcggcgagcggagccggaggagccgccgcaaagatggaggagccgtcgaggaggtgctgccgccgctgccgccgccgctgctgccgccgccgcccgcgaagccggagctcgagccgcagcgggtgagcgcgccgccccggcccagatcccatcttccccggaccccgggacgcgaggcggcgccccctcctcctgctgtctctgtccgcgggctcccagcgcgcgcgccgcgctccgcgccccccttccttcctcccggccctgggagccagccggcgccccccgggagcatcggcagcccgtgagcgggacatcggggttgctgcgcgcgcccctccctgcccctcccagacaggggcgccttccctacagcagatgggatgtcaggtcgggaaccatccttggaaatcctgccgcggacttctctgcacagcatccctgtgacagtggaggtgaagccggtgctgccaagagccatgcccagttccatggggggtgggg

SEQ ID NO: 141056 - DNA, 3662 bp, Homo sapiens
  Payload ID: 7719
  Gene Symbol: HDAC5
  Gene Name: histone deacetylase 5
  Uniprot ID: Q9UQL6
  ENST ID: ENST00000586802
  CDS Start-End: 212-3580
gacaggggcgccttccctacagggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaa

SEQ ID NO: 141057 - DNA, 667 bp, Homo sapiens
  Payload ID: 7719
  Gene Symbol: HDAC5
  Gene Name: histone deacetylase 5
  ENST ID: ENST00000591714
  CDS Start-End: 463-667
gggcctcctggcagcccgcccgcagctccctgagcatgctccacctatttatagacagggccctcccccaactgctatttcagtctcctgccagctgccggcggcggctcattcgggaaggaggagcagggagccgggcccagagctgtcacccagggttgggagggaacacagagcccgcctgcccgctgagctccccttcctgtcccaagtgctcagccataccccagctcccaggaaccagggagaggctggtggtcggatgcccctctagagcagagctgggcctgcagctctagggcctccctgcccctcctgccgccaggagtgcccaggccggatgaggcacttccctacagtgtgggtcccgtcggcagtggcctgagggaacctgtgctgtgcgggctgcccgaccaccttcccttcggtctgctccccgcctctggcggccccctccctggcatgctgctggtgcccaaggctcaggggctcgtggagatgctgcagaccatctatgagacagaatcctgtttctcagcagatgggatgtcaggtcgggaaccatccttggaaatcctgccgcggacttctctgcacagcatccctgtgacagtggaggtgaagccggtgctgccaagagccatgcccagttccatggggggtgggg

SEQ ID NO: 141058 - DNA, 4190 bp, Homo sapiens
  Payload ID: 7720
  Gene Symbol: HDAC6
  Gene Name: histone deacetylase 6
  Uniprot ID: Q9UBN7
  ENST ID: ENST00000334136
  CDS Start-End: 179-3826
gaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 141059 - DNA, 736 bp, Homo sapiens
  Payload ID: 7720
  Gene Symbol: HDAC6
  Gene Name: histone deacetylase 6
  ENST ID: ENST00000376610
  CDS Start-End: 105-736
gtacagcgcgtcgacggcggaggcgggaagggggcggaggccgaccgaaggcggctagggactggctgaagaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattag

SEQ ID NO: 141060 - DNA, 4179 bp, Homo sapiens
  Payload ID: 7720
  Gene Symbol: HDAC6
  Gene Name: histone deacetylase 6
  Uniprot ID: Q9UBN7
  ENST ID: ENST00000376619
  CDS Start-End: 168-3815
gttagcggtcgggtctgggcagggggtggagctggttgaaggaacggggcagtcccctgaggagcggggctggttgaaacgctaggggcgggatctggcggagtggaaggtaccggtccggcccgataaggggtggaaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 141061 - DNA, 907 bp, Homo sapiens
  Payload ID: 7720
  Gene Symbol: HDAC6
  Gene Name: histone deacetylase 6
  ENST ID: ENST00000376643
  CDS Start-End: 276-907
agctggcgtagcacgccgacgcaccgccccgccgcttgtgagctcgcgagaggtgtggctcgcgcgaggggcgcggccttgaggcacggtcccctctggaggcgggatctgggcgggcagtcgagagacgaggcccaatggaaaagaaaagcctgagcgctcgcgtccccacaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattag

SEQ ID NO: 141062 - DNA, 583 bp, Homo sapiens
  Payload ID: 7720
  Gene Symbol: HDAC6
  Gene Name: histone deacetylase 6
  ENST ID: ENST00000423941
  CDS Start-End: 157-583
agcccgcccgcgctacgtcatcacggcgcgtcgcgcgggaagtcgcggggaaaaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgt

SEQ ID NO: 141063 - DNA, 599 bp, Homo sapiens
  Payload ID: 7720
  Gene Symbol: HDAC6
  Gene Name: histone deacetylase 6
  ENST ID: ENST00000441703
  CDS Start-End: 117-599
agggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgag

SEQ ID NO: 141064 - DNA, 658 bp, Homo sapiens
  Payload ID: 7720
  Gene Symbol: HDAC6
  Gene Name: histone deacetylase 6
  ENST ID: ENST00000440653
  CDS Start-End: 144-658
gcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacga

SEQ ID NO: 141065 - DNA, 618 bp, Homo sapiens
  Payload ID: 7720
  Gene Symbol: HDAC6
  Gene Name: histone deacetylase 6
  ENST ID: ENST00000430858
  CDS Start-End: 1-254
ctacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 141066 - DNA, 882 bp, Homo sapiens
  Payload ID: 7720
  Gene Symbol: HDAC6
  Gene Name: histone deacetylase 6
  ENST ID: ENST00000426196
  CDS Start-End: 75-882
ggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccaggt

SEQ ID NO: 141067 - DNA, 568 bp, Homo sapiens
  Payload ID: 7720
  Gene Symbol: HDAC6
  Gene Name: histone deacetylase 6
  ENST ID: ENST00000443563
  CDS Start-End: 68-568
gaggcggagtttggaaggctgtggagaatcagatcgcaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtccta

SEQ ID NO: 141068 - DNA, 610 bp, Homo sapiens
  Payload ID: 7720
  Gene Symbol: HDAC6
  Gene Name: histone deacetylase 6
  ENST ID: ENST00000438518
  CDS Start-End: 458-610
atcacggcgcgtcgcgcgggaagtcgcggggaaaaggtaagatgccccttcctaattccctcgcttccttgcttgctctccagacaccgccgacccgaagggctcctaagtgactggacagggacggaggggcggcggctatggcatccgggacgacagcgacgatagccgaggcaagaaaaagcttgcaccgcagccctgtcgggaaccgccggcgcctgccttttacgtaggcgcagcacagctggcgtagcacgccgacgcaccgccccgtcgcctgtgagctcgcggtgtggctcagcccagctggcgtagcacgccgacgcaccgccccgccgcttgtgagctcgcgagaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaag

SEQ ID NO: 141069 - DNA, 4095 bp, Homo sapiens
  Payload ID: 7721
  Gene Symbol: HDAC7
  Gene Name: histone deacetylase 7
  Uniprot ID: Q8WUI4
  ENST ID: ENST00000080059
  CDS Start-End: 1-2976
atgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaa

SEQ ID NO: 141070 - DNA, 4065 bp, Homo sapiens
  Payload ID: 7721
  Gene Symbol: HDAC7
  Gene Name: histone deacetylase 7
  Uniprot ID: Q8WUI4
  ENST ID: ENST00000354334
  CDS Start-End: 82-2946
ggcgactggggggatgtgaggccggcgccccagccccccgccccgccatgagccccccgctctgagggccccggcccctggatgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaa

SEQ ID NO: 141071 - DNA, 3261 bp, Homo sapiens
  Payload ID: 7721
  Gene Symbol: HDAC7
  Gene Name: histone deacetylase 7
  ENST ID: ENST00000380610
  CDS Start-End: 8-3052
atttagaatgagtgacttgaggaagagggagctgggagcccttttcaccagcagggggactggaggagtcgaatgggatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacatgggtgccctcacactgagccagattccaggacatggttcctcacagcagcaggcaggaggagcattctcctggcctgggcacccatgcagagcggccgtggtgatggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagag

SEQ ID NO: 141072 - DNA, 569 bp, Homo sapiens
  Payload ID: 7721
  Gene Symbol: HDAC7
  Gene Name: histone deacetylase 7
  ENST ID: ENST00000417107
  CDS Start-End: 336-569
agataaagcatttccttccattgtcatcctacccggccggccgggctgccagggccctccccctcccggccccctcccttcctctcgccgtctcacagtcgctctgcagcctccggcgactggggggatgtgaggccggcgccccagccccccgccccgccatgagccccccgctctgagggccccggcccctggatgcacagccccggcgctgggtgaagagacacctgtgccctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagt

SEQ ID NO: 141073 - DNA, 645 bp, Homo sapiens
  Payload ID: 7721
  Gene Symbol: HDAC7
  Gene Name: histone deacetylase 7
  ENST ID: ENST00000434070
  CDS Start-End: 186-645
acacacacacacacacggtggaaactctatacccctgtgcctagtcagaaacagtgacggggagggacccagggaccaggcctcgagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacag

SEQ ID NO: 141074 - DNA, 555 bp, Homo sapiens
  Payload ID: 7721
  Gene Symbol: HDAC7
  Gene Name: histone deacetylase 7
  ENST ID: ENST00000447463
  CDS Start-End: 96-555
cttttaataggaacaggctggacccttccgttcccctcagcaggcatggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacag

SEQ ID NO: 141075 - DNA, 364 bp, Homo sapiens
  Payload ID: 7721
  Gene Symbol: HDAC7
  Gene Name: histone deacetylase 7
  ENST ID: ENST00000445237
  CDS Start-End: 211-364
attccaaggagcctagctctggctcctgaggtgaccccagcccagaagtcccattcccctctaccccaacccccagaatggcaggaggagcagggcagtctgggagtgacagatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggaca

SEQ ID NO: 141076 - DNA, 914 bp, Homo sapiens
  Payload ID: 7721
  Gene Symbol: HDAC7
  Gene Name: histone deacetylase 7
  ENST ID: ENST00000430670
  CDS Start-End: 91-914
gcagcctccggcgactggggggatgtgaggccggcgccccagccccccgccccgccatgagccccccgctctgagggccccggcccctggatgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccga

SEQ ID NO: 141077 - DNA, 579 bp, Homo sapiens
  Payload ID: 7721
  Gene Symbol: HDAC7
  Gene Name: histone deacetylase 7
  ENST ID: ENST00000450805
  CDS Start-End: 242-579
atcccgtggagccgggcagggccctactcagatccttcggcggggaaagaggtcccttggaggggtctctggctgggaggtttctctgagcattgccccccatccttgctcacccatcagggtgaagagacacctgtgccctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattcc

SEQ ID NO: 141078 - DNA, 576 bp, Homo sapiens
  Payload ID: 7721
  Gene Symbol: HDAC7
  Gene Name: histone deacetylase 7
  ENST ID: ENST00000417902
  CDS Start-End: 177-576
attgtcatcctacccggccggccgggctgccagggccctccccctcccggccccctcccttcctctcgccgtctcacagtcgctctgcagcctccggcgactggggggatgtgaggccggcgccccagccccccgccccgccatgagccccccgctctgagggccccggcccctggatgcacagccccggcgctggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggca

SEQ ID NO: 141079 - DNA, 621 bp, Homo sapiens
  Payload ID: 7721
  Gene Symbol: HDAC7
  Gene Name: histone deacetylase 7
  ENST ID: ENST00000425451
  CDS Start-End: 99-404
gtcgctctgcagcctccggcgactggggggatgtgaggccggcgccccagccccccgccccgccatgagccccccgctctgagggccccggcccctggatgcacagccccggcgctgctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcc

SEQ ID NO: 141080 - DNA, 402 bp, Homo sapiens
  Payload ID: 7721
  Gene Symbol: HDAC7
  Gene Name: histone deacetylase 7
  ENST ID: ENST00000433685
  CDS Start-End: 139-402
cgttcccctcagcaggcatggtgtgtgtgtgggggtgccagtgggggagggctgggcagtgattcaaatcagatcctggaactttcctgaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaag

SEQ ID NO: 141081 - DNA, 3016 bp, Homo sapiens
  Payload ID: 7721
  Gene Symbol: HDAC7
  Gene Name: histone deacetylase 7
  Uniprot ID: Q8WUI4
  ENST ID: ENST00000427332
  CDS Start-End: 158-3016
acaccctttttcttttaataggaacaggctggacccttccgttcccctcagcaggcatgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaa

SEQ ID NO: 141082 - DNA, 593 bp, Homo sapiens
  Payload ID: 7721
  Gene Symbol: HDAC7
  Gene Name: histone deacetylase 7
  ENST ID: ENST00000422254
  CDS Start-End: 170-593
cccctgggtcccgggagtgagtcacggcggagacgctgaggaggtgctggcgcagcaccccacccccaccgggcgaggggctgagcgcaggcctcgccccccagattccagcgctgaaggaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagcctgcccagtgaccccccagagcacttccctctgcgcaagacagtctctgagcccaacctgaagctgcgctataagccca

SEQ ID NO: 141083 - DNA, 580 bp, Homo sapiens
  Payload ID: 7721
  Gene Symbol: HDAC7
  Gene Name: histone deacetylase 7
  ENST ID: ENST00000440293
  CDS Start-End: 102-580
acagtcgctctgcagcctccggcgactggggggatgtgaggccggcgccccagccccccgccccgccatgagccccccgctctgagggccccggcccctggatgcacagccccggcgctggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagcctgcccagtgaccccccagagcacttccctctgcgcaagacagtctctgagcccaacctgaagctgcg

SEQ ID NO: 141084 - DNA, 583 bp, Homo sapiens
  Payload ID: 7721
  Gene Symbol: HDAC7
  Gene Name: histone deacetylase 7
  ENST ID: ENST00000421231
  CDS Start-End: 170-583
cccctgggtcccgggagtgagtcacggcggagacgctgaggaggtgctggcgcagcaccccacccccaccgggcgaggggctgagcgcaggcctcgccccccagattccagcgctgaaggaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttccc

SEQ ID NO: 141085 - DNA, 1479 bp, Homo sapiens
  Payload ID: 7721
  Gene Symbol: HDAC7
  Gene Name: histone deacetylase 7
  ENST ID: ENST00000548080
  CDS Start-End: 1-1154
ggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaaggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctcc

SEQ ID NO: 141086 - DNA, 569 bp, Homo sapiens
  Payload ID: 7721
  Gene Symbol: HDAC7
  Gene Name: histone deacetylase 7
  ENST ID: ENST00000547259
  CDS Start-End: 1-331
agacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacc

SEQ ID NO: 141087 - DNA, 2719 bp, Homo sapiens
  Payload ID: 7721
  Gene Symbol: HDAC7
  Gene Name: histone deacetylase 7
  ENST ID: ENST00000548938
  CDS Start-End: 1-185
gcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggttcactctaaagaagtagcattcctgggtcacatggtgtgagcattttgagagtcgttggtgtcctagacgcacagaaattgaccctcccacccgcaatgagcaggaccctcctctgaagacttcccacggggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttt

SEQ ID NO: 141088 - DNA, 724 bp, Homo sapiens
  Payload ID: 7721
  Gene Symbol: HDAC7
  Gene Name: histone deacetylase 7
  ENST ID: ENST00000485796
  CDS Start-End: 1-459
gagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagac

SEQ ID NO: 141089 - DNA, 3216 bp, Homo sapiens
  Payload ID: 7721
  Gene Symbol: HDAC7
  Gene Name: histone deacetylase 7
  Uniprot ID: Q8WUI4
  ENST ID: ENST00000552960
  CDS Start-End: 102-3026
acagtcgctctgcagcctccggcgactggggggatgtgaggccggcgccccagccccccgccccgccatgagccccccgctctgagggccccggcccctggatgcacagccccggcgctggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactgg

SEQ ID NO: 141090 - DNA, 3122 bp, Homo sapiens
  Payload ID: 7721
  Gene Symbol: HDAC7
  Gene Name: histone deacetylase 7
  ENST ID: ENST00000477203
  CDS Start-End: 216-890
ataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatc

SEQ ID NO: 141091 - DNA, 739 bp, Homo sapiens
  Payload ID: 7721
  Gene Symbol: HDAC7
  Gene Name: histone deacetylase 7
  ENST ID: ENST00000488927
  CDS Start-End: 1-616
gatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggtagtgatgataagaataatagcagataacatcagtacaccactaatcacatccagacactgatggttttacacatgatggatttaatcctgactataacccactttacagatgaaagacgtgcaccatggcaacggcacccagcaaaccttctaccaagaccccagtgtgctctacatctccctg

SEQ ID NO: 141092 - DNA, 833 bp, Homo sapiens
  Payload ID: 7722
  Gene Symbol: HDAC8
  Gene Name: histone deacetylase 8
  Uniprot ID: Q9BY41
  ENST ID: ENST00000373554
  CDS Start-End: 93-533
gcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtaagaaaatgacctttctgttttctgactctttccttgagtcagtttctcagttatgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaa

SEQ ID NO: 141093 - DNA, 704 bp, Homo sapiens
  Payload ID: 7722
  Gene Symbol: HDAC8
  Gene Name: histone deacetylase 8
  Uniprot ID: Q9BY41
  ENST ID: ENST00000373556
  CDS Start-End: 53-529
tccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaacta

SEQ ID NO: 141094 - DNA, 632 bp, Homo sapiens
  Payload ID: 7722
  Gene Symbol: HDAC8
  Gene Name: histone deacetylase 8
  Uniprot ID: Q9BY41
  ENST ID: ENST00000373559
  CDS Start-End: 52-471
ccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctg

SEQ ID NO: 141095 - DNA, 819 bp, Homo sapiens
  Payload ID: 7722
  Gene Symbol: HDAC8
  Gene Name: histone deacetylase 8
  ENST ID: ENST00000373560
  CDS Start-End: 64-534
ccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagt

SEQ ID NO: 141096 - DNA, 1037 bp, Homo sapiens
  Payload ID: 7722
  Gene Symbol: HDAC8
  Gene Name: histone deacetylase 8
  ENST ID: ENST00000373568
  CDS Start-End: 293-1037
gtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcat

SEQ ID NO: 141097 - DNA, 2133 bp, Homo sapiens
  Payload ID: 7722
  Gene Symbol: HDAC8
  Gene Name: histone deacetylase 8
  ENST ID: ENST00000373571
  CDS Start-End: 83-844
agaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagagccctctttatcagaactccttgaggactcattttccctacctggctataatcaaaacaactactccagaaacacctgcctgcctttatcctttcctctctcctaaataccaaacactcataaatgttatatgtatatgcttttcttgtgtgtcactctgtattacccgatcaattctaccatataaatttctcccaaatctatctcttcctccttatccttgctgtcactggcctggatggttgcaaaagccctcatcaaccttcagggtatcctacaatagagcttgagtatctttaaaatggaaatctaattatgccttcaaagcacacacacacagatgcacacatgcacccacacaatgtttgagacattttgtaccctttaagcaaaagtccaaactcattagcctgccgggcatatatagcccacgtttacctctctagcctcatcccaccactcccgctgtcaagccttcatgtttctgcatgcatacttccttctccggacttagtcccctaccagtaaccccacaatcatctctgcctccaacttccctatcgtcaccctacatacctataaatttctatacttttaaaaaaacttttattgcacaataatcacagattcacagaaggttgcaaaaaaatgtacagggaagtcccatgtacccttcttccagcctcccccaatgttgacatcttatacaattatattacggcatcaaaatgaagaagttgatattggacattggtacaagccatagagcttatttagatttcaccagctatatatgcacgtgtgtgtgtgtgtgtgtgtgtgtgtgtgtgtgtagctctatgcaattttatcacacatgtagccttgcataactacaaccacaatcaagatacagatcagtaccatcaccacaaggttccctcatgctacgcctttatagctacatccatccctaacccctggcaaccaactaatctattctccacctctgtaattattattttgcaaatgtaatatgaatgggctcatgcagcagataatcttttgagattggccttcttgacccagcacaattcccttgagagccacccagattttttgcatgtatcaatagtttgctcctttttattaatgagcaatattccagtggcatggttgtaccagtttgtttaaccatttatctgttgaaatacatctgggttgtttccaatgtttggctattacaaattgagctgctacgaacattcatgtacaagttcctacacaaaaataagtcttaaattatctgaaatacattgcccaagagtacaatt

SEQ ID NO: 141098 - DNA, 2014 bp, Homo sapiens
  Payload ID: 7722
  Gene Symbol: HDAC8
  Gene Name: histone deacetylase 8
  Uniprot ID: Q9BY41
  ENST ID: ENST00000373573
  CDS Start-End: 343-1476
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 141099 - DNA, 434 bp, Homo sapiens
  Payload ID: 7722
  Gene Symbol: HDAC8
  Gene Name: histone deacetylase 8
  ENST ID: ENST00000373583
  CDS Start-End: 77-271
gcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 141100 - DNA, 1740 bp, Homo sapiens
  Payload ID: 7722
  Gene Symbol: HDAC8
  Gene Name: histone deacetylase 8
  Uniprot ID: Q9BY41
  ENST ID: ENST00000373589
  CDS Start-End: 343-1203
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaacct

SEQ ID NO: 141101 - DNA, 913 bp, Homo sapiens
  Payload ID: 7722
  Gene Symbol: HDAC8
  Gene Name: histone deacetylase 8
  ENST ID: ENST00000415409
  CDS Start-End: 16-913
ggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaa

SEQ ID NO: 141102 - DNA, 592 bp, Homo sapiens
  Payload ID: 7722
  Gene Symbol: HDAC8
  Gene Name: histone deacetylase 8
  ENST ID: ENST00000421523
  CDS Start-End: 198-592
ccatgggctttgggggtgggggtgggggcggtggacgaaagagcgttaggaagcggagaggacactgggctgggggaaatcttcagaaatttcgagtagctgtatcagatacctaaagctgtatcagaaggaagtgttctcatatcgtttctgagagcgcagcatgtctcttcgggacgtccaatggacaggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcg

SEQ ID NO: 141103 - DNA, 679 bp, Homo sapiens
  Payload ID: 7722
  Gene Symbol: HDAC8
  Gene Name: histone deacetylase 8
  ENST ID: ENST00000412342
  CDS Start-End: 10-180
aagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgac

SEQ ID NO: 141104 - DNA, 607 bp, Homo sapiens
  Payload ID: 7722
  Gene Symbol: HDAC8
  Gene Name: histone deacetylase 8
  ENST ID: ENST00000444609
  CDS Start-End: 319-486
atggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagttaagcctaaagtggcctccatggaggagatggccaccttccacactgatgcttatctgcagcatctccagaaggtcagccaagagggcgatgatgatcatccggactccatagaatatgggcta

SEQ ID NO: 141105 - DNA, 2338 bp, Homo sapiens
  Payload ID: 7722
  Gene Symbol: HDAC8
  Gene Name: histone deacetylase 8
  Uniprot ID: Q9BY41
  ENST ID: ENST00000439122
  CDS Start-End: 288-1058
ataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgtta

SEQ ID NO: 141106 - DNA, 908 bp, Homo sapiens
  Payload ID: 7722
  Gene Symbol: HDAC8
  Gene Name: histone deacetylase 8
  ENST ID: ENST00000436675
  CDS Start-End: 98-655
ccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatgtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccaga

SEQ ID NO: 141107 - DNA, 3254 bp, Homo sapiens
  Payload ID: 7723
  Gene Symbol: HDAC9
  Gene Name: histone deacetylase 9
  Uniprot ID: Q9UKV0
  ENST ID: ENST00000401921
  CDS Start-End: 42-3119
atggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaatt

SEQ ID NO: 141108 - DNA, 4102 bp, Homo sapiens
  Payload ID: 7723
  Gene Symbol: HDAC9
  Gene Name: histone deacetylase 9
  ENST ID: ENST00000406072
  CDS Start-End: 53-1786
gcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 141109 - DNA, 4239 bp, Homo sapiens
  Payload ID: 7723
  Gene Symbol: HDAC9
  Gene Name: histone deacetylase 9
  Uniprot ID: Q9UKV0
  ENST ID: ENST00000405010
  CDS Start-End: 151-1923
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 141110 - DNA, 9705 bp, Homo sapiens
  Payload ID: 7723
  Gene Symbol: HDAC9
  Gene Name: histone deacetylase 9
  Uniprot ID: Q9UKV0
  ENST ID: ENST00000406451
  CDS Start-End: 151-3351
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaattctgaacagcagcttcacttgttctttggatggacttgaaagggcattaaagattccttaaacgtaaccgctgtgattctagagttacagtaaaccacgattggaagaaactgcttccagcatgcttttaatatgctgggtgacccactcctagacaccaagtttgaactagaaacattcagtacagcactagatattgttaatttcagaagctatgacagccagtgaaattttgggcaaaacctgagacatagtcattcctgacattctgatcagctttttttggggtaatttgtttttcaaacagtcttaacttgtttacaagatttgcttttagctatgaacggatcgtaattccacccagaatgtaatgtttcttgtttgtttgttttgttttgttagggtttttttctcaactttaacacacagttcaactgttcctagtaaaagttcaagatggaggaactagcatgaggcttttttcagtatctcgaagtccaaatgccaaaggaacctcacacactgtttgtaatggtgcaatattttatatcacttttttttaaacatccccaacatctttgtgttctcacacacaggcaatttgcaatgttgcaattgtgttggagaatgaagtccccccacctcccagccacacacacatcctttgttctcatgacagtaggtctgagcaaatgttccaccaagcattttcagtgtctttgaaaagcacgtaacttttcaaaggtggtcttaatttgttgcatatctatcaaggacttattcactcacctttccttttctgccctctatcaattgatttcttcttacctttcatcattcattccttcctttagaaaaactgaagattacccataatctcctcttattacttgagggccttgactatttagtttattttgtttactttacaggttaacacagttgttttgtctgattgcattttattaactgtgaagccgttgaaatgaatatcacttaagcaacgttgctaaatttctatgtgtttgaaatgtgttaatgaaggcactgcttatttgtagtcaccttgaactgacttaacctagaagctgtgccttcttgtgaaaaaaaaaaaaaacaaaaacaaaaaacagcctttaaacaagtttccttagtgtcaaaagttaaaaataaaggacatttatttctgagataaaaagtaacttactaaatataagtaggttatcctcctacctcctaaaattcgatttcaacatataactcaaacacctaaacatattgaggtagaatatctcacagtatttaatatctgacaatgcttttgaaagagttgatgtttctttttatatatttttctaactcaaaggatatattaaagccataagtgaagattgtcatgcttttattcagaaatctgaaagaaaccttaattaaaacaaggttttagggaaggccatgatatgaaagatatggaacaatatggttttagttagagaggactctaacctgtaaatcaaagatgaaagatttcactcaagtagaattatataactccctttgttatacagtcagaccatatttttcatgcatttggtttttttaggattaccattttaattttaaagacttttattacatatacaaaaatggctcaatacttggtttaacttcttagaaatttgagacaccctttgaaataggaaatctgaaatggaatgtaacttagtattaggtaaaaattgctttcattgcgtaagggcaaattcagtctagattcatagtagtaatcaattttttataaattttattttcatgagaaattcataccaatcatatttgctagcttatgttattttgcagtgattgcttgaggatatttacttaaaaaaatagtagagccaaaggcttaacaaaagactctcccccattttaaaaaggaaactcatgttttaattagaaaaataattgtgtagttttaaaatcaacttcataattataaatctctgtcattactttttagtcctcccagatatttttttagttgttgaataagaaaataaaacagtgtaatgcaaacatgctaatttactaaagtttcctacaacagtttagccacatgtttatgccaagccattaatctgataaagccaaatcactaggacatctccatggttatttagatttaaaacttgacacattaatgagttaatcacacatactcccatatgacaccatacccaattggttgcacttagagtctttaaaatacctggagaagcaaatgaactgtggagaggattatccacagcatgtagttgtaagaacagaatgccattgctttttgattataccattacaagatggagcatagccctgagggacagaatggaggctttccgaaaatatcaacacttcttttgaaatagaccagcactttttgaaagggtagtttcacttggtatagtttttcttcacttacccgtttaaattttattgctcgcagttgttctgaatgagaggctagaagagtattatcaattttgcatctccttgtgatacttactttgaaggaaaatcacatacgctctctcatggtctcatggtatctcatacagggtgaataaaaatgatttttgataaatctactagtaaataatactaggaatttaataagctgtcaaacgtaggtataaaaagaaggcttaaaaattaattttcccaattgtataatttggggctgtatattaaactaaaaaacacagacagttttattaaatagtaaccaaaatggactcaaataaaaccagaggctatgttaccattgcttagtaaatggaaagaacattgtgagatgaactatctttaaatattgtaacaagtttataacatcaatagtggagacagaagtcagctttggagaaaatagagatatttatgaaaaaactactacaaatcacatttccattaccaatcctggggatggaaatattgccttcagtttttactccagccctatacgacactctcactaacctttcactgacaacatcatggccttgaaagcagggatctcctcccacaaaggcttcagaaattacaggactggtctctcttaatagtttagtcctgctttatttccaaagggcaattataaagcctcgtggatttactgggtttctttacagactccatatggaagtaaaatagaatgatcatttggaaagtctcctgggaaaaaattcctcttcaatcagcattttaaaacttttttatttttgagtcagagttttgctcttggtgcccaggctggagtgcaatggcgcaatctcgactcactgcaacctccgcctcccgggttcaagcaattctcctgacgagtagctgggcatgcgccaccacgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagaggatgacatttgtaagtgaacgtggtatactcacacatgctatactcatactacataacttagtttctccaaatcaactgcagtccgttttatctatgatattcctggcttcgtataatggttttgtaaaatacattaaatacaattaagtccgttattactatgctggaaataactaggtcagacaatgaaaccttagacttttgattggggctgtttggacttgatccaatgataaggtaataaggttgttgcaatttctcaaagcatcttaattctcaaactgaaacatttagcaaatacatggtgaatctggtgtaaacttacaatctaacaaataattttctttcaactcttctctttttctgcctaacaatctatacgaaattgccaatatctaagcaatcaaaagtttctgaaatctctgtttccttagtagaaatgaccttgacaacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattccttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaataaaa

SEQ ID NO: 141111 - DNA, 2307 bp, Homo sapiens
  Payload ID: 7723
  Gene Symbol: HDAC9
  Gene Name: histone deacetylase 9
  Uniprot ID: Q9UKV0
  ENST ID: ENST00000456174
  CDS Start-End: 246-1934
ctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattag

SEQ ID NO: 141112 - DNA, 799 bp, Homo sapiens
  Payload ID: 7723
  Gene Symbol: HDAC9
  Gene Name: histone deacetylase 9
  ENST ID: ENST00000413380
  CDS Start-End: 356-799
gctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcag

SEQ ID NO: 141113 - DNA, 2359 bp, Homo sapiens
  Payload ID: 7723
  Gene Symbol: HDAC9
  Gene Name: histone deacetylase 9
  Uniprot ID: Q9UKV0
  ENST ID: ENST00000428307
  CDS Start-End: 141-1781
ggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggt

SEQ ID NO: 141114 - DNA, 2524 bp, Homo sapiens
  Payload ID: 7723
  Gene Symbol: HDAC9
  Gene Name: histone deacetylase 9
  Uniprot ID: Q9UKV0
  ENST ID: ENST00000417496
  CDS Start-End: 362-2128
gcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctgacctcatgtggaaccttgtaccatgggtgctattctgtggctgctgtaggatcttcccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatcta

SEQ ID NO: 141115 - DNA, 584 bp, Homo sapiens
  Payload ID: 7723
  Gene Symbol: HDAC9
  Gene Name: histone deacetylase 9
  ENST ID: ENST00000441986
  CDS Start-End: 254-584
gtgcatattcagtctgcttagggacagcagcttctgaatgaaattgcaaactattgcttctgatgaaagatgagactgagataagtaaaatgtagttgggggtgttttgcctttactatgcaactagaaaaaggagctgtgtactgattgtaagcctattctaataggactttaaaaatcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacag

SEQ ID NO: 141116 - DNA, 3210 bp, Homo sapiens
  Payload ID: 7723
  Gene Symbol: HDAC9
  Gene Name: histone deacetylase 9
  Uniprot ID: Q9UKV0
  ENST ID: ENST00000441542
  CDS Start-End: 1-3210
atgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtga

SEQ ID NO: 141117 - DNA, 602 bp, Homo sapiens
  Payload ID: 7723
  Gene Symbol: HDAC9
  Gene Name: histone deacetylase 9
  ENST ID: ENST00000433709
  CDS Start-End: 535-602
gagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggagtacctggtaaaatgctgtggtgtatggagacagttatgagaaactggagggaggatgatagttgagatggggtggctggacgagagcagctcttggctcagcaaagaatgcacagtatgatcagctcagtggatgtgaagtcagaagttcctgtgggcctggagcccatctcacc

SEQ ID NO: 141118 - DNA, 3099 bp, Homo sapiens
  Payload ID: 7723
  Gene Symbol: HDAC9
  Gene Name: histone deacetylase 9
  Uniprot ID: Q9UKV0
  ENST ID: ENST00000432645
  CDS Start-End: 1-3036
atgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacattta

SEQ ID NO: 141119 - DNA, 545 bp, Homo sapiens
  Payload ID: 7723
  Gene Symbol: HDAC9
  Gene Name: histone deacetylase 9
  ENST ID: ENST00000430454
  CDS Start-End: 334-545
agccaacttgagctgagagagactgagaaagggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagttgaactatgggtgttgactttcttttcatgaagataatatatctgtttaaatactaattggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaact

SEQ ID NO: 141120 - DNA, 550 bp, Homo sapiens
  Payload ID: 7723
  Gene Symbol: HDAC9
  Gene Name: histone deacetylase 9
  ENST ID: ENST00000413509
  CDS Start-End: 136-550
aatattataacggatacagaaaagttcagaaggactgagctagtttgcgaaaccacagcacactttggcaaagagggaatgcacaacaaaacggatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaa

SEQ ID NO: 141121 - DNA, 560 bp, Homo sapiens
  Payload ID: 7723
  Gene Symbol: HDAC9
  Gene Name: histone deacetylase 9
  ENST ID: ENST00000446646
  CDS Start-End: 128-244
agtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcag

SEQ ID NO: 141122 - DNA, 2199 bp, Homo sapiens
  Payload ID: 7723
  Gene Symbol: HDAC9
  Gene Name: histone deacetylase 9
  Uniprot ID: Q9UKV0
  ENST ID: ENST00000524023
  CDS Start-End: 206-1747
tttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctgggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactg

SEQ ID NO: 141123 - DNA, 4279 bp, Homo sapiens
  Payload ID: 7723
  Gene Symbol: HDAC9
  Gene Name: histone deacetylase 9
  ENST ID: ENST00000622668
  CDS Start-End: 320-1969
ggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagtttttttt

SEQ ID NO: 141124 - DNA, 3163 bp, Homo sapiens
  Payload ID: 7724
  Gene Symbol: HINFP
  Gene Name: histone H4 transcription factor
  Uniprot ID: Q9BQA5
  ENST ID: ENST00000350777
  CDS Start-End: 64-1617
cggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagatcgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttatttatttcttcttacatttggtggcagtttactaggtaatgaggagatacagccacccagaagaggagctgaatagttaggcttgttccccttctggtgactcaggtggtttgttttttgtttgcttaactgtcctgttgtcttctcctcctccccttggtgaaacttcgctattctcagagcgtatgccatttccatggaggtcccaggtgtttggctgtgagtgggcagtagtggtgctatagaatgaacaagaatgggctcactgggaggatagggcagctgaccatggcctcactctgaatactgattagaacccagtgcctctagggtaggggttctttacctgggagtgggaaggaagctggggggtggagaggattgggaagcctcccagggaagggaggcaatcaagtggtccaggaaccaaactagaaaattgtgtgtctgaatgtgcattttcctggggaaaggatctgttttttgctagattatcaaagagattgaaacctcccaaaataagaatcatcatttcgtctggttcagctgcttctcagcaccctgtgtccatttttatggtctactgctatgctggagaggtcaaggaaatagtcttggggacaggaagctgcccaaaaaggatctctgggcctttttttgtaagacctaattctattactagaaaaactaaggctgaatgcagtggttcacgcctgtaatcccaacactttgggaggctgaggcgggcggatcacaaggtcaagagatggagaccatcctggccaacatggtgaaaccccgtctctactaaaaatataaaaatcagctgggcatggtggcacacatctgtagtcccagctactcgggaggctgaggcaggagaattgcttgaacccgggaggctgaggttgcagtgagccgagatcatgccactgcactccagcctggcgacacagtgagactccgtctcaaataaataaataaataaa

SEQ ID NO: 141125 - DNA, 572 bp, Homo sapiens
  Payload ID: 7724
  Gene Symbol: HINFP
  Gene Name: histone H4 transcription factor
  ENST ID: ENST00000529988
  CDS Start-End: 273-572
aagagctgaagagacctggagccgacagacgtctaggggcttcgctgcggctgagactcggtcgccgccacgccttagcgtgaaggattccgggaagcctgcgggactgcgagtggagaggttttgcccaacgggacggtctccttccttctgtccaaattctacctgtccttcgaggcgtggtgcgggccccactgcttaggggagacttccttttcgcctgaccgcggaggtgtctctctgtcctggtctccctcatcggggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctg

SEQ ID NO: 141126 - DNA, 676 bp, Homo sapiens
  Payload ID: 7724
  Gene Symbol: HINFP
  Gene Name: histone H4 transcription factor
  ENST ID: ENST00000530678
  CDS Start-End: 515-676
agattgaatcttgctctgtcactaggctggagtgcaatggtgcgatctcggctcactgcaacctctgtctcccgggttcaagtgattcccctgcctcagcctccatagtagctgggactacaggcgtgtgccaccatacctagctaattttttgtatttggccaggatggtctcaatctcctgaccttgtgatcccctcgcctcggcctcccaaagtgctgggattacaggcataagccactgcgcccggctgatttttgtatttttagtagagacggaattttgccatgttgcccaggctggtcacaaactcctgagctcaagccatttgctcacctcagcctcccaaagtgctaagatcgtgagccactgcactcggcccagcagtcaatatttgtaatagggattcactagtagtctgtgagcagctcagcaaccctatatgcaccccagagtgttaaggatgactggattcttctctgaggaggagaaaaggctatgtagggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaa

SEQ ID NO: 141127 - DNA, 1466 bp, Homo sapiens
  Payload ID: 7724
  Gene Symbol: HINFP
  Gene Name: histone H4 transcription factor
  Uniprot ID: Q9BQA5
  ENST ID: ENST00000527410
  CDS Start-End: 35-1294
gaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcgcctcggccatttctgtatccccctgcctgggtttgctgccctttatgctcctacctcaccaggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctca

SEQ ID NO: 141128 - DNA, 967 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000443524
  CDS Start-End: 76-804
gaggccacccggaagaccaagccgggtaggcgctgtctccgtcgcctccaacccccccggtccgaccagggaagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagag

SEQ ID NO: 141129 - DNA, 1477 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000419348
  CDS Start-End: 70-900
aagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcc

SEQ ID NO: 141130 - DNA, 1748 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000451739
  CDS Start-End: 442-1170
aggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcct

SEQ ID NO: 141131 - DNA, 886 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000421577
  CDS Start-End: 29-757
gcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatca

SEQ ID NO: 141132 - DNA, 774 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000532081
  CDS Start-End: 98-499
tcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaa

SEQ ID NO: 141133 - DNA, 595 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000532505
  CDS Start-End: 61-462
ctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaata

SEQ ID NO: 141134 - DNA, 713 bp, Homo sapiens
  Payload ID: 7725
  Gene Symbol: HTATIP2
  Gene Name: HIV-1 Tat interactive protein 2, 30kDa
  Uniprot ID: Q9BUP3
  ENST ID: ENST00000530266
  CDS Start-End: 67-468
aggtcccgcccctgtgggcggggcgaggcagcgtcgccgcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgttt

SEQ ID NO: 141135 - DNA, 1060 bp, Homo sapiens
  Payload ID: 7725
  Gene Symbol: HTATIP2
  Gene Name: HIV-1 Tat interactive protein 2, 30kDa
  ENST ID: ENST00000531058
  CDS Start-End: 59-649
aggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcgggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattg

SEQ ID NO: 141136 - DNA, 2775 bp, Homo sapiens
  Payload ID: 7726
  Gene Symbol: HTATSF1
  Gene Name: HIV-1 Tat specific factor 1
  Uniprot ID: O43719
  ENST ID: ENST00000218364
  CDS Start-End: 175-2442
gcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaa

SEQ ID NO: 141137 - DNA, 1014 bp, Homo sapiens
  Payload ID: 7726
  Gene Symbol: HTATSF1
  Gene Name: HIV-1 Tat specific factor 1
  ENST ID: ENST00000448450
  CDS Start-End: 281-1014
gtcggcgcgacccgcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaa

SEQ ID NO: 141138 - DNA, 885 bp, Homo sapiens
  Payload ID: 7726
  Gene Symbol: HTATSF1
  Gene Name: HIV-1 Tat specific factor 1
  ENST ID: ENST00000425695
  CDS Start-End: 216-885
gcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaat

SEQ ID NO: 141139 - DNA, 3019 bp, Homo sapiens
  Payload ID: 7726
  Gene Symbol: HTATSF1
  Gene Name: HIV-1 Tat specific factor 1
  Uniprot ID: O43719
  ENST ID: ENST00000535601
  CDS Start-End: 423-2690
agtggccctcgccccgccccaaacccgaccccggtgggcgtcgacgcgcagcagcagcgggtccccccaaccccggcgccccgcctccccgggcctcgcgccgcatgccggcgtcggcgctttttgacgccatagtgggcgtgtcggcgcgacccgcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactg

SEQ ID NO: 141140 - DNA, 2929 bp, Homo sapiens
  Payload ID: 7727
  Gene Symbol: HKR1
  Gene Name: HKR1, GLI-Kruppel zinc finger family member
  Uniprot ID: P10072
  ENST ID: ENST00000324411
  CDS Start-End: 270-2249
gctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaa

SEQ ID NO: 141141 - DNA, 2772 bp, Homo sapiens
  Payload ID: 7727
  Gene Symbol: HKR1
  Gene Name: HKR1, GLI-Kruppel zinc finger family member
  Uniprot ID: P10072
  ENST ID: ENST00000392153
  CDS Start-End: 174-2096
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcaccct

SEQ ID NO: 141142 - DNA, 2854 bp, Homo sapiens
  Payload ID: 7727
  Gene Symbol: HKR1
  Gene Name: HKR1, GLI-Kruppel zinc finger family member
  ENST ID: ENST00000544914
  CDS Start-End: 1023-2183
gggtctgcagatggcgtccgagtgcacagtggccagtgtgattccgcagtcttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaaaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctc

SEQ ID NO: 141143 - DNA, 2758 bp, Homo sapiens
  Payload ID: 7727
  Gene Symbol: HKR1
  Gene Name: HKR1, GLI-Kruppel zinc finger family member
  ENST ID: ENST00000541583
  CDS Start-End: 290-2086
aactgacgtgctgagcagctaattcagtgcctgaggttacactagttgtggacagagatgggttccaaatccagatagtatgggttgaatccacgctcttcatcaccacccactttccctccttaggcctgagcaggcacgtggcagcatttggtagaggaaggagtgagccctgctgtaggaactatatatattggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctca

SEQ ID NO: 141144 - DNA, 527 bp, Homo sapiens
  Payload ID: 7727
  Gene Symbol: HKR1
  Gene Name: HKR1, GLI-Kruppel zinc finger family member
  ENST ID: ENST00000589188
  CDS Start-End: 460-527
gcagatggcgtccgagtgcacagtggccagtgtgattccgcagtcttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggtccagatttggaacaagtctctctagagattgaacagagctgcgcctggaacccgccgcagggaggagacctgaagaccagaggaaacacagcaagcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctca

SEQ ID NO: 141145 - DNA, 510 bp, Homo sapiens
  Payload ID: 7727
  Gene Symbol: HKR1
  Gene Name: HKR1, GLI-Kruppel zinc finger family member
  ENST ID: ENST00000586897
  CDS Start-End: 94-369
gcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagatgaagtctcactctgttgcctaggctggagtgcagtggcgcgatctcggctcactgcaacctccacctcctggtttcaagcagttctctgcctcagcctcccgattagctgggactacagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaaca

SEQ ID NO: 141146 - DNA, 573 bp, Homo sapiens
  Payload ID: 7727
  Gene Symbol: HKR1
  Gene Name: HKR1, GLI-Kruppel zinc finger family member
  ENST ID: ENST00000592768
  CDS Start-End: 253-573
agtgtgtagcgttgacgtcagaaacacttccggtcggtggcccaggcgcgttaagctggttgggacccgggaaggcctccctcttaaggtctttcccacacctctgcaccttgttacctgactttcggcttcaggatccgcagcgtgcacccgcgttccgcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagt

SEQ ID NO: 141147 - DNA, 525 bp, Homo sapiens
  Payload ID: 7727
  Gene Symbol: HKR1
  Gene Name: HKR1, GLI-Kruppel zinc finger family member
  ENST ID: ENST00000591417
  CDS Start-End: 237-512
gtcagaaacacttccggtcggtggcccaggcgcgttaagctggttgggacccgggaaggcctccctcttaaggtctttcccacacctctgcaccttgttacctgactttcggcttcaggatccgcagcgtgcacccgcgttccgcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagatggagccttgctctgttgccaggctggaatacagtggtgttatatcggctcactgcaacctctgcctcctgggttcaagcaattcccctgcctcagcctcctgagtagctgggactacagaatcgaagccagaaattcaacttagtccctcctgccct

SEQ ID NO: 141148 - DNA, 568 bp, Homo sapiens
  Payload ID: 7727
  Gene Symbol: HKR1
  Gene Name: HKR1, GLI-Kruppel zinc finger family member
  ENST ID: ENST00000585623
  CDS Start-End: 338-568
gtcggtggcccaggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcctgagcaggcacgtggcagcatttggtagaggaaggagtgagccctgctgtaggaactatatatattggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctg

SEQ ID NO: 141149 - DNA, 3472 bp, Homo sapiens
  Payload ID: 7727
  Gene Symbol: HKR1
  Gene Name: HKR1, GLI-Kruppel zinc finger family member
  ENST ID: ENST00000591471
  CDS Start-End: 1642-2802
aggtcccgcctccgccagcctctcacagcccggaggcacctcccattggcgcctgacgggttggttagggcggcttttcttccggctgtgacaaatccagcctgaggagcgctcctgtgtctttcttagttgtttcttcccgcccacctgcccctcaaagccacaacccacttgcacaccaccgtgtggacacctaaaagcgaccgtctagatctgaaccgcgctgagggaatggtcagcttctctcccattagatggcttggcccaaaggacctagcgactgcccagacaaaaatttcttctgacatgctgcatgtgtctgtggtctctaagagtcaaaaccaaagccaaaagaaaaagacaaccccgccccccgcgaaacaacaacaacaacaacaacaacaacaacaaacaccaccaccaacccacctttcacgagaggagtccttgagaagagcctctccagccagaaccaggtccagatttggaacaagtctctctagagattgaacagagctgcgcctggaacccgccgcagggaggagacctgaagaccagaggaaacacagcaaacagagtctcgctctgttgcccaggctggagtgtagtatggcgatctctgctcactgcaagctctgccttccgggttcacaccattctcccacctcagcccctggagtagttgggactacaggctcatgctaccacacctggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagggggaatggtttcagctttcgcccattcagtatgaagttggctgtaggtctgtcacagataactcttcttattttgagatgaagtctcactctgttgcctaggctggagtgcagtggcgcgatctcggctcactgcaacctccacctcctggtttcaagcagttctctgcctcagcctcccgattagctgggactacagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcct

SEQ ID NO: 141150 - DNA, 734 bp, Homo sapiens
  Payload ID: 7727
  Gene Symbol: HKR1
  Gene Name: HKR1, GLI-Kruppel zinc finger family member
  ENST ID: ENST00000591259
  CDS Start-End: 128-643
gtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattcttttctttattttaaaa

SEQ ID NO: 141151 - DNA, 704 bp, Homo sapiens
  Payload ID: 7727
  Gene Symbol: HKR1
  Gene Name: HKR1, GLI-Kruppel zinc finger family member
  ENST ID: ENST00000590582
  CDS Start-End: 309-704
tgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagagaaattccatcttctaaaccaaaactcattgctcagctggagcgaggggaagcgccctggagagaggagagaaaatgtccactggacctctgtccagggggaatggtttcagctttcgcccattcagtatgaagttggctgtaggtctgtcacagataactcttcttattttgag

SEQ ID NO: 141152 - DNA, 556 bp, Homo sapiens
  Payload ID: 7727
  Gene Symbol: HKR1
  Gene Name: HKR1, GLI-Kruppel zinc finger family member
  ENST ID: ENST00000587437
  CDS Start-End: 169-294
gcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagag

SEQ ID NO: 141153 - DNA, 547 bp, Homo sapiens
  Payload ID: 7727
  Gene Symbol: HKR1
  Gene Name: HKR1, GLI-Kruppel zinc finger family member
  ENST ID: ENST00000591134
  CDS Start-End: 231-371
gggttccaaatccagatagtatgggttgaatccacgctcttcatcaccacccactttccctccttaggcctgagcaggcacgtggcagcatttggtagaggaaggagtgagccctgctgtaggaactatatatattggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagacacagaatgaagacattgtgtgaggacctgagctgctgcagctaccttgcaaccacataaagcaacactgccaatacattgaggactgcagagcaggaggaaggattcttgctacaattggtcacctgctaagccaactgaacttcttgctaagtggggaaataaatatctttactgtataagcta

SEQ ID NO: 141154 - DNA, 2152 bp, Homo sapiens
  Payload ID: 7727
  Gene Symbol: HKR1
  Gene Name: HKR1, GLI-Kruppel zinc finger family member
  ENST ID: ENST00000589392
  CDS Start-End: 138-2063
gcgttaagctggttgggacccgggaaggcctccctcttaaggtctttcccacacctctgcaccttgttacctgactttcggcttcaggatccgcagcgtgcacccgcgttccgaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggct

SEQ ID NO: 141155 - DNA, 566 bp, Homo sapiens
  Payload ID: 7727
  Gene Symbol: HKR1
  Gene Name: HKR1, GLI-Kruppel zinc finger family member
  ENST ID: ENST00000592168
  CDS Start-End: 290-454
tcggtggcccaggcgcgttaagctggttgggacccgggaaggcctccctcttaaggtctttcccacacctctgcaccttgttacctgactttcggcttcaggatccgcagcgtgcacccgcgttccgcctgagcaggcacgtggcagcatttggtagaggaaggagtgagccctgctgtaggaactatatatattggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagggggaatggtttcagctttcgcccattcagtatgaagttggctgtaggtctgtcacagataactcttcttattttgagcagaatcgaagccagaaattcaacttagtccctcctgccctctgattttctccagtcagcaagctctca

SEQ ID NO: 141156 - DNA, 563 bp, Homo sapiens
  Payload ID: 7727
  Gene Symbol: HKR1
  Gene Name: HKR1, GLI-Kruppel zinc finger family member
  ENST ID: ENST00000591391
  CDS Start-End: 182-563
cggtggcccaggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaac

SEQ ID NO: 141157 - DNA, 480 bp, Homo sapiens
  Payload ID: 7727
  Gene Symbol: HKR1
  Gene Name: HKR1, GLI-Kruppel zinc finger family member
  ENST ID: ENST00000589801
  CDS Start-End: 368-480
cgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaactggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggttgtattaaatgtgttaaagta

SEQ ID NO: 141158 - DNA, 576 bp, Homo sapiens
  Payload ID: 7727
  Gene Symbol: HKR1
  Gene Name: HKR1, GLI-Kruppel zinc finger family member
  ENST ID: ENST00000590166
  CDS Start-End: 512-576
tggtctttcactccttggtgccaaggtcacaatccaaagtagggtctagaaatctttcctacttccctcagggaagccttttgacctctcattctttttttttttttttgagacagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgc

SEQ ID NO: 141159 - DNA, 1720 bp, Homo sapiens
  Payload ID: 7728
  Gene Symbol: HCG27
  Gene Name: HLA complex group 27 (non-protein coding)
  ENST ID: ENST00000383331
  CDS Start-End: 1-569
atttctctactcacctgtctccgaatccgtcgtggtgtttcaagcgagtcaagattccagatcgcgccccaggctggactcggaattactgccccgcgggtctgcattttcacagcggcaggtggcttgtggtccctgacaaggaggaccctgagggcaaccacaccttgccatgcagagcacctggcttctcatctgccaagctcactctgacccggctgcaggaagggaaggagccaaccccggactcaagactcaaggggaccagaaccagggagatgagacataccagggctgggcagctgtgggggtccttccagagaggagctgagatacgcctacctggaggggcccctgggcctggaggggctcctcagtgtgactgggtgaagtgttttcagaggaccagggttgaggttgggggcatctcatccagaccctgccggcatctgccccagaacccaagggcccctccttcctccctcctcaatggaaatgctggagatgtcctcagtcaccctctgagcactcacacatcaccccttatttggaaatttttctcactctaaccttccttcctgccgcaccttctgccccatccccaggctctggcctctctctctcctcttctaccctttagcaggtaatgactcagttcccactgaggagccagctgtaggtgagagtttgggctctcggtgaggttgggagaaggaaaaggcttatgggccagggggtgggagggagaatgggcacagccagagcagagtggaagggttgggggaggcgataaagacagatgtttccgtattaccatttttctttcatggtccgagggagctgcccttcccccaagcccaggaaagtgaaaagagaagcaggaacagtaaaatactccacaggaaagaaaaatcttagtgatccctcctgctgtctctttccttttgcctattctggcaaattttgtaagtgaaatttgttaccaagatgtgaaaatcttataagaaagtctctaaatatttgagaataaaattatcaatgtctcagctctgcaggctgaaaaaacggaggctttacaaaataaaatcatgcttggaaaacttctcctctgagggatgtcaaaggctgcactgaataagctctaaggtggtgctgaaatgagtcatttatttgcctgtgtaagctcaggcaggtgttggaattgaggaagtataggtaatgaaaaaagtaaacatgtcctcgggacatagcgactggtgatgaccacacaatcaacacaataaactctagcattcacattgtagtccagctcattcaagcaaagctatctccaatagggagtttaccctgtacagaacacgtgcatttccacctgttctcagactgaccctttgctcatcacaatagtgaaaaaaaacacagccctgggtggagatttaagatgctaatgagtcatgagatgtatgaacaagcatgtacagctactgcacacgtgcacccagaagaccgcccagaacatgcttgctagtaacacctcttcccacccacctcctgtgaataatcatgtaagactcccataaagggagtttctccagcagtgatcaatgctgtctcatccttaggagcagcccaccctgaatcctctcagggtgtacagtttattttgcacttaactttcaaaataatatttttcctttgtaataaattgctttgtacttca

SEQ ID NO: 141160 - DNA, 895 bp, Homo sapiens
  Payload ID: 7728
  Gene Symbol: HCG27
  Gene Name: HLA complex group 27 (non-protein coding)
  ENST ID: ENST00000424675
  CDS Start-End: 1-490
gcagtggcgcctaaagtctgcaaggaggaggtcgcctctgtgctggcttgtggtccctgacaaggaggaccctgagggcaaccacaccttgccatgcagagcacctggcttctcatctgccaagctcactctgacccggctgcaggaagggaaggagccaaccccggactcaagactcaaggggaccagaaccagggagatgagacataccagggctgggcagctgtgggggtccttccagagaggagctgagatacgcctacctggaggggcccctgggcctggaggggctcctcagtgtgactgggtgaagtgttttcagaggaccagggttgaggttgggggcatctcatccagaccctgccggcatctgccccagaacccaagggcccctccttcctccctcctcaatggaaatgctggagatgtcctcagtcaccctctgagcactcacacatcaccccttatttggaaatttttctcactctaaccttccttcctgccgcaccttctgccccatccccaggctctggcctctctctctcctcttctaccctttagcaggtaatgactcagttcccactgaggagccagctgtaggtgagagtttgggctctcggtgaggttgggagaaggaaaaggcttatgggccagggggtgggagggagaatgggcacagccagagcagagtggaagggttgggggaggcgataaagacagatgtttccgtattaccatttttctttcatggtccgagggagctgcccttcccccaagcccaggaaagtgaaaagagaagcaggaacagtaaaatactccacaggaaagaaaaatcttagtgatccctcctgctgtctctttccttttgcctattctggcaaattttgtaagtgaa

SEQ ID NO: 141161 - DNA, 1184 bp, Homo sapiens
  Payload ID: 7729
  Gene Symbol:
  Gene Name: HLA-DRB4
  ENST ID: ENST00000457451
  CDS Start-End: 64-864
atagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacatggagttaaaaa

SEQ ID NO: 141162 - DNA, 878 bp, Homo sapiens
  Payload ID: 7729
  Gene Symbol:
  Gene Name: HLA-DRB4
  ENST ID: ENST00000618157
  CDS Start-End: 24-833
ctacttttcccttcgtctcaattatgtcttggaaaaaggctttgcggatccccggaggccttcgggcagcaactgttaccttgatgctggcgatgctgagcaccccagtggctgagggcagagactctcccgaggatttcgtgtaccagtttaaggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgaggtgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagcttt

SEQ ID NO: 141163 - DNA, 4974 bp, Homo sapiens
  Payload ID: 7730
  Gene Symbol: HMGXB3
  Gene Name: HMG box domain containing 3
  Uniprot ID: Q12766
  ENST ID: ENST00000502717
  CDS Start-End: 465-4343
gccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagctgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctt

SEQ ID NO: 141164 - DNA, 5275 bp, Homo sapiens
  Payload ID: 7730
  Gene Symbol: HMGXB3
  Gene Name: HMG box domain containing 3
  ENST ID: ENST00000503427
  CDS Start-End: 862-4644
atgagagggaaagactgagacaggctgaggtcaggccttgaacgtcgtgctgaggagagggtggtattgtaggcttcccagcgcccgacgtggctctgaaaggtgaggcggggcctagatccctcacgctcagcacagccccgcccctgttacctgaacgccccacagcagtgcccgggggctgagcggccggggcgtcccaccgccggcagccacagcttcctcctccgcccgggacctctggccggaagcagtccgttcgccttactagacccgctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagctgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctt

SEQ ID NO: 141165 - DNA, 975 bp, Homo sapiens
  Payload ID: 7730
  Gene Symbol: HMGXB3
  Gene Name: HMG box domain containing 3
  ENST ID: ENST00000514469
  CDS Start-End: 1-337
actgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaag

SEQ ID NO: 141166 - DNA, 5567 bp, Homo sapiens
  Payload ID: 7730
  Gene Symbol: HMGXB3
  Gene Name: HMG box domain containing 3
  Uniprot ID: Q12766
  ENST ID: ENST00000613459
  CDS Start-End: 1-4617
atgcagagaacacagccccgcccctgttacctgaacgccccacagcagtgcccgggggctgagcggccggggcgtcccaccgccggcagccacagcttcctcctccgcccgggacctctggccggaagcagtccgttcgccttactagacccgctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagctgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgt

SEQ ID NO: 141167 - DNA, 4047 bp, Homo sapiens
  Payload ID: 7731
  Gene Symbol: HMGXB4
  Gene Name: HMG box domain containing 4
  Uniprot ID: Q9UGU5
  ENST ID: ENST00000216106
  CDS Start-End: 129-1934
cttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaa

SEQ ID NO: 141168 - DNA, 4216 bp, Homo sapiens
  Payload ID: 7731
  Gene Symbol: HMGXB4
  Gene Name: HMG box domain containing 4
  ENST ID: ENST00000418170
  CDS Start-End: 140-418
gcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgta

SEQ ID NO: 141169 - DNA, 1257 bp, Homo sapiens
  Payload ID: 7731
  Gene Symbol: HMGXB4
  Gene Name: HMG box domain containing 4
  ENST ID: ENST00000420166
  CDS Start-End: 403-1257
gctctgggctcgactgaggctccctggccgctcgcgcttttctctccttctccaagatggcggcgatcggcggcgttgaggcgggatccgggcgagccgagtgaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaa

SEQ ID NO: 141170 - DNA, 1325 bp, Homo sapiens
  Payload ID: 7731
  Gene Symbol: HMGXB4
  Gene Name: HMG box domain containing 4
  ENST ID: ENST00000455359
  CDS Start-End: 474-1325
tccttctccaagatggcggcgatcggcggcgttgaggcgggatccgggcgagccgagtgaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaa

SEQ ID NO: 141171 - DNA, 2829 bp, Homo sapiens
  Payload ID: 7732
  Gene Symbol: HBP1
  Gene Name: HMG-box transcription factor 1
  Uniprot ID: O60381
  ENST ID: ENST00000222574
  CDS Start-End: 187-1731
ggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctga

SEQ ID NO: 141172 - DNA, 702 bp, Homo sapiens
  Payload ID: 7732
  Gene Symbol: HBP1
  Gene Name: HMG-box transcription factor 1
  ENST ID: ENST00000497535
  CDS Start-End: 378-702
ggggaaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtgg

SEQ ID NO: 141173 - DNA, 601 bp, Homo sapiens
  Payload ID: 7732
  Gene Symbol: HBP1
  Gene Name: HMG-box transcription factor 1
  ENST ID: ENST00000479011
  CDS Start-End: 269-601
gctcggcgtggtggcatgtgcctgtaatcccccctacttaggtggctgaggcgggagaatcgcttgaacccaggaggtggagtttgcagtgagccgagatcacgccactgcactgcagtctgggtgacagagtgtgactatgtctcaaaaaaaaaacaaaacaacattgtcatgtctctgatttattttaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggcta

SEQ ID NO: 141174 - DNA, 2332 bp, Homo sapiens
  Payload ID: 7732
  Gene Symbol: HBP1
  Gene Name: HMG-box transcription factor 1
  ENST ID: ENST00000498408
  CDS Start-End: 1-1365
cagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtaaaaatagtgataattctgattacaataaatgagtaacacttcaatacggttcatggtaactggaatagttaagtaaacttattctttaatagcttttattcaactcttaggttgacttttttgtttgtttttgagacggagtctcgctgtgtcacccaagctggagtccagtggtacgatctcagctcactgcaacctccgccttccaggttcaagtgattatcctgcctcagcctctcaagtagctgagactacaggcgcccaccaccatacctggctaattttttgtatttttagtagagacagggtttcaccatgttggccaggctgatctcgaactcctgacctcgtgatccacccaccttggcctcctaaagtgccgtgattacaggcgtgagccactgtgcccggccaggttgactttaaagtaaaaagtttaagtggaatttttagggttatatgtaattattttataatacatagacaattaggttatctaccttagtagtaaggatctaccttttattatttgtgccatagcccaggctgcagtacagcggcgcaactcactgtagcctgtatctcccaggctcaatcctcccacctcagcttcctgaatggctgggattacaggcacatgccaccacacccagttaatttttgtattttttgtagagatagggttgtgccatgttgcccaggctggtctcaaactcctgggttcaagccatctgcctgcctcccaaagtgcaagatctaccttttaaaatcatgttatttatctgttggaggacacggttctaacaattaacagttctatctttatggaacagcttttcacctgagtcaactatggattgtacggggaactggcaatttgtagcaagctgccagagttgtcaaaacggtgaacttaagagctgtcctcagtagaagctggaaataaaaatcaactcaagtccttccta

SEQ ID NO: 141175 - DNA, 563 bp, Homo sapiens
  Payload ID: 7732
  Gene Symbol: HBP1
  Gene Name: HMG-box transcription factor 1
  ENST ID: ENST00000478930
  CDS Start-End: 352-563
gacgaagcttgaaagacttggtaatggcgacgggtttggagttttgggatggtggttgataactaagacaaagtgctgaagaaatgatagaagttgcaaagagacgttagtgtactatacttggtgaatgttggaaactgcaggacctgctgtagggaagaaaaaagttctagctggaaagaatgaggaaaccaaagagctctgcagagggagggggaagacaagacagactgcagctgtgcttctgtggaccccaagaacagcactgttcatacacagaggatagctctgaagagagatacctgtgtagtgcagcttctaaatttcataataaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctaccca

SEQ ID NO: 141176 - DNA, 2420 bp, Homo sapiens
  Payload ID: 7732
  Gene Symbol: HBP1
  Gene Name: HMG-box transcription factor 1
  Uniprot ID: O60381
  ENST ID: ENST00000485846
  CDS Start-End: 672-2216
aaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgaggagttttgggatggtggttgataactaagacaaagtgctgaagaaatgatagaagttgcaaagagacgttagtgtactatacttggtgaatgttggaaactgcaggacctgctgtagggaagaaaaaagttctagctggaaagaatgaggaaaccaaagagctctgcagagggagggggaagacaagacagactgcagctgtgcttctgtggaccccaagaacagcactgttcatacacagaggatagctctgaagagagatacctgtgtagtgcagcttctaaatttcataataaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacatttt

SEQ ID NO: 141177 - DNA, 433 bp, Homo sapiens
  Payload ID: 7732
  Gene Symbol: HBP1
  Gene Name: HMG-box transcription factor 1
  ENST ID: ENST00000463790
  CDS Start-End: 1-258
tcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagacggagtctcgctgtgtcacccaagctggagtccagtggtacgatctcagctcactgcaacctccgccttccaggttcaaagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaag

SEQ ID NO: 141178 - DNA, 478 bp, Homo sapiens
  Payload ID: 7732
  Gene Symbol: HBP1
  Gene Name: HMG-box transcription factor 1
  ENST ID: ENST00000464009
  CDS Start-End: 106-478
gaaagacttggtaatggcgacgggtttggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccac

SEQ ID NO: 141179 - DNA, 573 bp, Homo sapiens
  Payload ID: 7732
  Gene Symbol: HBP1
  Gene Name: HMG-box transcription factor 1
  ENST ID: ENST00000468401
  CDS Start-End: 489-573
agttcgaatgaatgggctcccaggcgcctgcgcgctggggctgagccgaggggaaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatga

SEQ ID NO: 141180 - DNA, 2704 bp, Homo sapiens
  Payload ID: 7732
  Gene Symbol: HBP1
  Gene Name: HMG-box transcription factor 1
  Uniprot ID: O60381
  ENST ID: ENST00000468410
  CDS Start-End: 83-1627
aacccccagggggttgaggggagggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaa

SEQ ID NO: 141181 - DNA, 476 bp, Homo sapiens
  Payload ID: 7732
  Gene Symbol: HBP1
  Gene Name: HMG-box transcription factor 1
  ENST ID: ENST00000607681
  CDS Start-End: 1-464
ctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaatta

SEQ ID NO: 141182 - DNA, 2452 bp, Homo sapiens
  Payload ID: 7733
  Gene Symbol:
  Gene Name: HMP19 protein [Source:EntrezGene
  Acc:51617]
  Uniprot ID: Q9Y328
  ENST ID: ENST00000303177
  CDS Start-End: 263-778
acagatggtgtgggagcgcgttccccggtaggagggggcgcgagcgagcaagcaggcaggcagctgccaggagctcttccctgctcgctcacgcctgctctcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 141183 - DNA, 603 bp, Homo sapiens
  Payload ID: 7733
  Gene Symbol:
  Gene Name: HMP19 protein [Source:EntrezGene
  Acc:51617]
  ENST ID: ENST00000517587
  CDS Start-End: 161-445
agaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacgtgtctgccacacagcacaggcccagtgaaagtggaccaagacccagctgcgtacaagtacttgcaggaataagcaggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcct

SEQ ID NO: 141184 - DNA, 643 bp, Homo sapiens
  Payload ID: 7733
  Gene Symbol:
  Gene Name: HMP19 protein [Source:EntrezGene
  Acc:51617]
  ENST ID: ENST00000519867
  CDS Start-End: 207-643
gatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcac

SEQ ID NO: 141185 - DNA, 1260 bp, Homo sapiens
  Payload ID: 7733
  Gene Symbol:
  Gene Name: HMP19 protein [Source:EntrezGene
  Acc:51617]
  ENST ID: ENST00000521585
  CDS Start-End: 123-422
tcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtgcacagaacatggcatttctcaacctcctgcagaggggcagggatgctggaccagttccagtcaatgaaatgtggatggaagtgatcgtaaattgaaaacactatgaggacactgaggcacaggaagtcaagaaacctgcacaaagccatgcaacaaccagccagtatctgagtcatgaccaaagcccagagcccagtctgccttcttgtctgaggtcctttcgacagcctgcattgcttatcttctaggacaatctggccctagggaaggaggccacctggacagcaccatggcgacacagagggcaccagatatgggaaagtttctctctgagaccatgtttgcttctgtttctcaagccaagttaattctctcctagaacaacgccagttagaaatgggggaagctactgaaatacctttggtggcttgtcttgcatcgatattattttctcccactgaggagttagagggtttctggttatgtgctatgtaaattctttggctcattcttttttttccatccttccctccatggtccatcaggaaaatcatggttaaatgagtgagtaaaagcttatgatttgcccgtccacgtcccaacttccttcttcctttagacctttttgtgtgacatgtattttctttgaccctgattttttatttatagcttctactttattgaaagcactcttgtaagctgcctctattcctttgtggattgaaacagagtgtaaggaaataaaatattatctttttttcagaaaaagaacattttggaaaatgaaagtgtattttccgtgtttgttttgttttgtgatagaaacagaagataagggaaggattatccaattctacaagctttgtgctctggggaatacaggactgatgcttgatattaaatgtatgtgctacagtgtaaa

SEQ ID NO: 141186 - DNA, 568 bp, Homo sapiens
  Payload ID: 7733
  Gene Symbol:
  Gene Name: HMP19 protein [Source:EntrezGene
  Acc:51617]
  ENST ID: ENST00000521278
  CDS Start-End: 93-568
aaaaaaaaaaaaaaatggcccttcgctattgaggaaatggaggcattccatggctgaataacaggatcaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgt

SEQ ID NO: 141187 - DNA, 613 bp, Homo sapiens
  Payload ID: 7733
  Gene Symbol:
  Gene Name: HMP19 protein [Source:EntrezGene
  Acc:51617]
  Uniprot ID: Q9Y328
  ENST ID: ENST00000519717
  CDS Start-End: 98-613
gctattttctctgtcgtcagccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactag

SEQ ID NO: 141188 - DNA, 3442 bp, Homo sapiens
  Payload ID: 7734
  Gene Symbol: HNF1A
  Gene Name: HNF1 homeobox A
  ENST ID: ENST00000257555
  CDS Start-End: 227-2122
agctccaatgtaaacagaacaggcaggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaa

SEQ ID NO: 141189 - DNA, 725 bp, Homo sapiens
  Payload ID: 7734
  Gene Symbol: HNF1A
  Gene Name: HNF1 homeobox A
  ENST ID: ENST00000544574
  CDS Start-End: 119-244
cagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgc

SEQ ID NO: 141190 - DNA, 2014 bp, Homo sapiens
  Payload ID: 7734
  Gene Symbol: HNF1A
  Gene Name: HNF1 homeobox A
  ENST ID: ENST00000544413
  CDS Start-End: 21-1937
ggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggagga

SEQ ID NO: 141191 - DNA, 2819 bp, Homo sapiens
  Payload ID: 7734
  Gene Symbol: HNF1A
  Gene Name: HNF1 homeobox A
  ENST ID: ENST00000543427
  CDS Start-End: 144-1502
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 141192 - DNA, 1594 bp, Homo sapiens
  Payload ID: 7734
  Gene Symbol: HNF1A
  Gene Name: HNF1 homeobox A
  Uniprot ID: P20823
  ENST ID: ENST00000541924
  CDS Start-End: 119-862
cagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgc

SEQ ID NO: 141193 - DNA, 3332 bp, Homo sapiens
  Payload ID: 7734
  Gene Symbol: HNF1A
  Gene Name: HNF1 homeobox A
  ENST ID: ENST00000541395
  CDS Start-End: 24-2012
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtaaggtccaggcctgctggccctcccttggcctgtgacagagcccctcacccccacatcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaa

SEQ ID NO: 141194 - DNA, 1649 bp, Homo sapiens
  Payload ID: 7734
  Gene Symbol: HNF1A
  Gene Name: HNF1 homeobox A
  Uniprot ID: P20823
  ENST ID: ENST00000538646
  CDS Start-End: 119-955
cagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgc

SEQ ID NO: 141195 - DNA, 3039 bp, Homo sapiens
  Payload ID: 7734
  Gene Symbol: HNF1A
  Gene Name: HNF1 homeobox A
  Uniprot ID: P20823
  ENST ID: ENST00000540108
  CDS Start-End: 24-383
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaa

SEQ ID NO: 141196 - DNA, 3030 bp, Homo sapiens
  Payload ID: 7734
  Gene Symbol: HNF1A
  Gene Name: HNF1 homeobox A
  ENST ID: ENST00000560968
  CDS Start-End: 1-1070
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 141197 - DNA, 2337 bp, Homo sapiens
  Payload ID: 7734
  Gene Symbol: HNF1A
  Gene Name: HNF1 homeobox A
  ENST ID: ENST00000400024
  CDS Start-End: 202-1830
ggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgcgtgtctgggtgtgtatcggttgtgcatgcatttgtgtgcatgcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggaggcacgtgcctgtagtcccagctacttgggaggctgaggcagaatcgcttgaacctgggaggcggaggttgcagtgagctgagattgtgccactgcactgcactccagcctgggcaacagagtgagtactctgccaaaaaaaaaaaaaagaaaaa

SEQ ID NO: 141198 - DNA, 2473 bp, Homo sapiens
  Payload ID: 7734
  Gene Symbol: HNF1A
  Gene Name: HNF1 homeobox A
  ENST ID: ENST00000617366
  CDS Start-End: 144-851
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 141199 - DNA, 2344 bp, Homo sapiens
  Payload ID: 7734
  Gene Symbol: HNF1A
  Gene Name: HNF1 homeobox A
  ENST ID: ENST00000615446
  CDS Start-End: 344-1027
cttggctagtggggttttgggggggcagtgggtgcaaggagtttggtttgtgtctgccggccggcaggcaaacgcaacccacgcgggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 141200 - DNA, 1546 bp, Homo sapiens
  Payload ID: 7735
  Gene Symbol: HNF1B
  Gene Name: HNF1 homeobox B
  ENST ID: ENST00000613727
  CDS Start-End: 135-1508
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaatgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgac

SEQ ID NO: 141201 - DNA, 1820 bp, Homo sapiens
  Payload ID: 7735
  Gene Symbol: HNF1B
  Gene Name: HNF1 homeobox B
  ENST ID: ENST00000617272
  CDS Start-End: 135-1412
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatggatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgac

SEQ ID NO: 141202 - DNA, 1546 bp, Homo sapiens
  Payload ID: 7735
  Gene Symbol: HNF1B
  Gene Name: HNF1 homeobox B
  ENST ID: ENST00000614955
  CDS Start-End: 135-1508
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaatgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgac

SEQ ID NO: 141203 - DNA, 2977 bp, Homo sapiens
  Payload ID: 7735
  Gene Symbol: HNF1B
  Gene Name: HNF1 homeobox B
  Uniprot ID: P35680
  ENST ID: ENST00000617811
  CDS Start-End: 364-2037
tgagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaacctccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccaaatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcact

SEQ ID NO: 141204 - DNA, 1103 bp, Homo sapiens
  Payload ID: 7735
  Gene Symbol: HNF1B
  Gene Name: HNF1 homeobox B
  ENST ID: ENST00000619478
  CDS Start-End: 222-1103
aatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcgcctacgatcggcaaaagaaccccagcaagagagagaggccttagtggaggaatgcaacaggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctga

SEQ ID NO: 141205 - DNA, 1103 bp, Homo sapiens; identical to SEQ ID NO: 141204
  Payload ID: 7735
  Gene Symbol: HNF1B
  Gene Name: HNF1 homeobox B
  ENST ID: ENST00000620125
  CDS Start-End: 222-1103

SEQ ID NO: 141206 - DNA, 1819 bp, Homo sapiens
  Payload ID: 7735
  Gene Symbol: HNF1B
  Gene Name: HNF1 homeobox B
  ENST ID: ENST00000614313
  CDS Start-End: 135-1781
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgac

SEQ ID NO: 141207 - DNA, 1971 bp, Homo sapiens
  Payload ID: 7735
  Gene Symbol: HNF1B
  Gene Name: HNF1 homeobox B
  Uniprot ID: P35680
  ENST ID: ENST00000621123
  CDS Start-End: 176-1771
agaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctat

SEQ ID NO: 141208 - DNA, 1820 bp, Homo sapiens
  Payload ID: 7735
  Gene Symbol: HNF1B
  Gene Name: HNF1 homeobox B
  ENST ID: ENST00000616941
  CDS Start-End: 135-1412
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatggatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgac

SEQ ID NO: 141209 - DNA, 2978 bp, Homo sapiens
  Payload ID: 7735
  Gene Symbol: HNF1B
  Gene Name: HNF1 homeobox B
  Uniprot ID: P35680
  ENST ID: ENST00000610754
  CDS Start-End: 364-2037
tgagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaaccaccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccacatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcacta

SEQ ID NO: 141210 - DNA, 1971 bp, Homo sapiens
  Payload ID: 7735
  Gene Symbol: HNF1B
  Gene Name: HNF1 homeobox B
  Uniprot ID: P35680
  ENST ID: ENST00000633792
  CDS Start-End: 176-1771
agaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgacggacgtcctgctggcacctcagacaatccactctcaggaggcgcagcccgaagcccagtttcccttctat

SEQ ID NO: 141211 - DNA, 1819 bp, Homo sapiens
  Payload ID: 7735
  Gene Symbol: HNF1B
  Gene Name: HNF1 homeobox B
  ENST ID: ENST00000632625
  CDS Start-End: 135-1781
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgac

SEQ ID NO: 141212 - DNA, 4001 bp, Homo sapiens
  Payload ID: 7736
  Gene Symbol: HNRNPUL2-BSCL2
  Gene Name: HNRNPUL2-BSCL2 readthrough (NMD candidate)
  ENST ID: ENST00000403734
  CDS Start-End: 229-2469
gttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggatggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 141213 - DNA, 1776 bp, Homo sapiens
  Payload ID: 7737
  Gene Symbol: HJURP
  Gene Name: Holliday junction recognition protein
  ENST ID: ENST00000414924
  CDS Start-End: 67-1776
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgca

SEQ ID NO: 141214 - DNA, 823 bp, Homo sapiens
  Payload ID: 7737
  Gene Symbol: HJURP
  Gene Name: Holliday junction recognition protein
  ENST ID: ENST00000433484
  CDS Start-End: 1-206
aaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagcctgggcgacagggcaagactccatctcaaaaaaaaaaaaaaaaaaaaaagaagagtccctggagacagatgggacactctaggcctcccctcaccgcttggcacagtgcctggccttaggcacgctgtcagcatgcgtgtggatgaactccgagtgaagacacaaagctagtttccgaccctttgggccagtgggctgtcagacaaacgtacttggggggaaatcggaaatgaagtggctcattaaggccaaagttccctttgcctcattgtcttggttctgggctgtcaccaccttacagtcacaagtctactcc

SEQ ID NO: 141215 - DNA, 2934 bp, Homo sapiens
  Payload ID: 7737
  Gene Symbol: HJURP
  Gene Name: Holliday junction recognition protein
  Uniprot ID: Q8NCD3
  ENST ID: ENST00000441687
  CDS Start-End: 67-2058
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaatatttcacatattcagaatacattggtgaaactcatgctggagtaaatagttaatatatggccat

SEQ ID NO: 141216 - DNA, 634 bp, Homo sapiens
  Payload ID: 7737
  Gene Symbol: HJURP
  Gene Name: Holliday junction recognition protein
  ENST ID: ENST00000453122
  CDS Start-End: 36-404
agtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcct

SEQ ID NO: 141217 - DNA, 3027 bp, Homo sapiens
  Payload ID: 7737
  Gene Symbol: HJURP
  Gene Name: Holliday junction recognition protein
  Uniprot ID: Q8NCD3
  ENST ID: ENST00000432087
  CDS Start-End: 67-2151
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaatatttcacatattcagaatacattggtgaaactcatgctggagtaaatagttaatatatggccat

SEQ ID NO: 141218 - DNA, 806 bp, Homo sapiens
  Payload ID: 7737
  Gene Symbol: HJURP
  Gene Name: Holliday junction recognition protein
  ENST ID: ENST00000454020
  CDS Start-End: 1-806
gggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattg

SEQ ID NO: 141219 - DNA, 3187 bp, Homo sapiens
  Payload ID: 7737
  Gene Symbol: HJURP
  Gene Name: Holliday junction recognition protein
  Uniprot ID: Q8NCD3
  ENST ID: ENST00000411486
  CDS Start-End: 67-2313
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaatatttcacatattcagaatacattggtgaaactcatgctggagtaaatagttaatatatggcc

SEQ ID NO: 141220 - DNA, 6010 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENST ID: ENST00000336648
  CDS Start-End: 472-2652
acgagagggcgcagcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacagttcggtttttgcccactagggatgatgtggtttctcatgaggttacttgctctaaaggactttatattttggaaccataagagcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaaca

SEQ ID NO: 141221 - DNA, 6466 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENST ID: ENST00000399120
  CDS Start-End: 1232-3412
ggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacaggtgcacgctaccatgcccggctaatttttgtatttttagtagaggcgggggtttcaccatgccatccaggctggtttcgaactcctgacctcgtgatccacctgtctcggcctcccaaagtgctgggattacaggtgtgagccaccgcgcctggccctgtattttcaaattctttacctctgcgtttccagccttgctccatccaatttgttactagagctttttaacaatttcacgttgaattaagatgatttggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcagagaagatatgccttgcctgctgccatacattgtaacatcaagtcaagagctttagttacttaacagatttctgctggctgctattataggaggaaactcctttgtttagggacagccagggcttccttagctttgatctttgggagtgagccttttgcttgacttcccttctcttttccatgcctttgtttccatctcgaagtgcaaatttaaagtgtcctgtttgcctttatccactggaaggcaaacaccctggacgacgtatcagtgacagcgcggttctgctttgatcggagcacccagcgctgcttgaaggcgtttgcatggtccatggctcatggaccacgctcctagaaaacggaaatgcacttagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtg

SEQ ID NO: 141222 - DNA, 780 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENST ID: ENST00000448340
  CDS Start-End: 504-780
ggccgcccggggctctggggactcgggtgtccaggtgccgaagtcgccgcttccacgggggactcaggcccgtgagtgggtttcctaagaacttaccagattccacggctcgggtttcctgccttggatcctgctttttattccccagggggagttatttatagacaggaatcgtgtgttcaaggcctggctcttcggactcggcgtttttcttgttcgaggtgcttcaatgggggctggatgccatcatcttccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggag

SEQ ID NO: 141223 - DNA, 702 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENST ID: ENST00000419461
  CDS Start-End: 443-702
catgctcatcacgctgtgctacctgtacctgtgggcgcgctggggtcgccggccggctgagctcgtgcgcgccacggtgcggcggctgcgtgcctcgcgctgttccttcaccttctgcggcgcggccgcgcagcccccgggcgcccgcgtgtgcctgagccgtggcggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctgg

SEQ ID NO: 141224 - DNA, 666 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  ENST ID: ENST00000427746
  CDS Start-End: 436-666
agcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggaga

SEQ ID NO: 141225 - DNA, 6112 bp, Homo sapiens
  Payload ID: 7738
  Gene Symbol: HLCS
  Gene Name: holocarboxylase synthetase (biotin-(proprionyl-CoA-carboxylase (ATP-hydrolysing)) ligase)
  Uniprot ID: P50747
  ENST ID: ENST00000612277
  CDS Start-End: 574-2754
gtgctggcgaggcagggcctgagcagccagtggagaagggcagcgggaagtgcgctgtgcaggagccagacgtctcagcccgtgtggccagaggtggcaggggcgcggcctgagcggggctggggcgcgggcaggatttggggctgcgccgaggggcgtcccgacctggccctttgccacgtccattgaagacttgaacaagtgggccctatttcttgtgtctccttttatacttgaagcagaacacatagcatttgtgacggagagcatttgggtacaaagtgagaatttacagagatcatcctcttcagaaacagttcggtttttgcccactagggatgatgtggtttctcatgaggttacttgctctaaaggactttatattttggaaccataagagcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtggtttgggctccctcttatttttacaagtttcatttttaaaagtaggcaactactttgggttacagtatttttattcatatttaaacatttttacaaaataaataaagtgttttacatagtaaggaatatgtacgtatttccaagtattaagaagccaagtgtttttttttttgacgtattattgacaaatgtattcagcgccatacacaagagaaatattattactccaaagaacgaaagttaacaaaactccaaagcaaaaacccttttaatggaggtgagaaataaatttaatgtaacaaca

SEQ ID NO: 141226 - DNA, 2277 bp, Homo sapiens
  Payload ID: 7739
  Gene Symbol: HCCS
  Gene Name: holocytochrome c synthase
  Uniprot ID: P53701
  ENST ID: ENST00000321143
  CDS Start-End: 203-1009
gtgcgtgagaacgccggcggtgaccgcagccacagcggtgaccgagtgagaggaaggcggcggcggcggcggcggcggcgtgaagtcactgctgctctgggttcgggttggcgactgaaggcggtaccggcctcccggaacagcccgggggagggcttaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggt

SEQ ID NO: 141227 - DNA, 1072 bp, Homo sapiens
  Payload ID: 7739
  Gene Symbol: HCCS
  Gene Name: holocytochrome c synthase
  Uniprot ID: P53701
  ENST ID: ENST00000380762
  CDS Start-End: 197-1003
ggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 141228 - DNA, 1000 bp, Homo sapiens
  Payload ID: 7739
  Gene Symbol: HCCS
  Gene Name: holocytochrome c synthase
  Uniprot ID: P53701
  ENST ID: ENST00000380763
  CDS Start-End: 125-931
ccgagtgagaggaaggcggcggcggcggcggcggcggcgtgaagtcactgctgctctgggttcgggttggcgactgaaggcggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 141229 - DNA, 2517 bp, Homo sapiens
  Payload ID: 7740
  Gene Symbol: HOXA1
  Gene Name: homeobox A1
  Uniprot ID: P49639
  ENST ID: ENST00000343060
  CDS Start-End: 63-1070
aggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaa

SEQ ID NO: 141230 - DNA, 2016 bp, Homo sapiens
  Payload ID: 7740
  Gene Symbol: HOXA1
  Gene Name: homeobox A1
  ENST ID: ENST00000355633
  CDS Start-End: 85-498
tttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaa

SEQ ID NO: 141231 - DNA, 2541 bp, Homo sapiens
  Payload ID: 7741
  Gene Symbol: HOXA10
  Gene Name: homeobox A10
  Uniprot ID: P31260
  ENST ID: ENST00000283921
  CDS Start-End: 1-1233
atgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaatttta

SEQ ID NO: 141232 - DNA, 1570 bp, Homo sapiens
  Payload ID: 7741
  Gene Symbol: HOXA10
  Gene Name: homeobox A10
  Uniprot ID: P31260
  ENST ID: ENST00000396344
  CDS Start-End: 607-891
aaccaaagtctctcaagttgctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaa

SEQ ID NO: 141233 - DNA, 2175 bp, Homo sapiens
  Payload ID: 7741
  Gene Symbol: HOXA10
  Gene Name: homeobox A10
  ENST ID: ENST00000613671
  CDS Start-End: 1-609
atgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaatttt

SEQ ID NO: 141234 - DNA, 2295 bp, Homo sapiens
  Payload ID: 7742
  Gene Symbol: HOXA11
  Gene Name: homeobox A11
  Uniprot ID: P31270
  ENST ID: ENST00000006015
  CDS Start-End: 73-1014
cttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaa

SEQ ID NO: 141235 - DNA, 2137 bp, Homo sapiens
  Payload ID: 7742
  Gene Symbol: HOXA11
  Gene Name: homeobox A11
  ENST ID: ENST00000517402
  CDS Start-End: 1-851
ggatccgcttcaaagaggcagctgcagtggagaatcatgttaagctcggctactgcggagagcccaaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttc

SEQ ID NO: 141236 - DNA, 5030 bp, Homo sapiens
  Payload ID: 7743
  Gene Symbol: HOXA13
  Gene Name: homeobox A13
  Uniprot ID: P31271
  ENST ID: ENST00000222753
  CDS Start-End: 30-1196
actggggtcttctccatgcggctcgggctatgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcggcggccgcggctgcggcggcggccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcgggcgcagaggccgccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacatgatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtatacatttgcatattagtgcttgtgtgtgcttgtatatatatttgtagaatctgtacagatatcatatcattaattgctaatgacgcaagatattgtaatttaaggtgatttctagaattgaggtacaaaatgtactttacaagatgaagccttgttccttttctctaatggccaaatttgatttgtcttcacagtggcttgctctgcatcagatttctgcagatctgctttaaagctgtacatttttgttacagtctaagatgtgttcttaaatcaccattccttcctggtcctcaccctccagggtggtctcacactgtaattagagctattgaggagtctttacagcaaattaagattcagatgccttgctaagtctagagttctagagttatgtttcagaaagtctaagaaacccacctcttgagaggtcagtaaagaggacttaatatttcatatctacaaaatgaccacaggattggatacagaacgagagttatcctggataactcagagctgagtactgctccagggtggtgtgcaatcttatattgatgcttgtgaatctgccatttgatttgtaggataaataaatatgtttaatattaacaacttccatcaaaactataataataatattatatctactgttgacctctaacaacaatcaggtgctgtattcagagtcataaagaatacatatgtatgtttgtatatttaatatacacataggataatgtgtttttgtcaaatctatgctatgcgcatatgtattaaaatgttggtggaatcagtagccgtgggatgcagaattgtgagatgcaggctaattttatctttacgttagaggaaagtaatagtgaatggaagaaccagattcatcattttatggaaaataatattgattggttacaaaagtggctgccggaaacctctccaacctctcctgaggactcacaacttctttatagatgagaattacgaaagagtctctaaagctgtctcaaaaacaggctggtgttgaaacatacatatcgaaaggtctcgagaaattcaattatattttgctgccctgaggattttcactccacttgtggaaacaaatgataatgttgcttcagacccacctctccacctcttgttccaaacagtactccatttccaaatgagctgccatcaagccaaagtaacaactttctcccaaaatgtttaaagtggtggaaaatcccctcaaagctggatcaaactgtgtgtttaagaacagctccaaaagggactcttctgttgacaggggatatttttctttagatgtaagaaatattctgagcctcgagcctaggaaggaggccaacagcagctctccagccgggatcccgcccctttcgaaagccatcaccactacaggaaccctgggtaaagtagtagccttctttttttctctctctagtttttgaaactgtaatgacagaagacatttcagggttgttgtggggattttttccccccagttctaaaatggtcattgatagtgtcgatcttacctaactctcctcctatttaaaatttctgtggatctaccagataacctaaagtgggcatggattatttattatggctcctttaatgcccaaatagcaatcagtctaaaaccttaaaacaaaaacaaaaacaaaaacaaaaatcaaggagagaccagccacctcctgaaaaataggaataatagtatcagccactgacccatggataatgttgttgaaagcctgattaaagtatttttttctaaaaagaaaactcttcctgaattaagaaaataaaaatgggactttaaaaaaaaa

SEQ ID NO: 141237 - DNA, 1814 bp, Homo sapiens
  Payload ID: 7744
  Gene Symbol: HOXA2
  Gene Name: homeobox A2
  Uniprot ID: O43364
  ENST ID: ENST00000222718
  CDS Start-End: 312-1442
cccgacttttttggatcaatcaaacagacagtggcttcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagta

SEQ ID NO: 141238 - DNA, 2761 bp, Homo sapiens
  Payload ID: 7745
  Gene Symbol: HOXA3
  Gene Name: homeobox A3
  Uniprot ID: O43365
  ENST ID: ENST00000317201
  CDS Start-End: 527-1858
actaacgctggactccatttgactcttttgcaggctacgtgtgccgcctggccattcaaactgtcaattttaggtccagaagtgtccaaaccacaagttctcaaaactctctgaaaaatggctccctccgagttaagcaattctgaaaggcattctctgggaaaagtctgtggaggagagagggatcttcttgcaaataatgtggtctcaggcaaggacacagcatcttggctgtctgctaaaaaaaaaaaatgcctagactctcagtggaaattgagtgtcaagctgcaaaatctcaaatggcagactatcatcatttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaat

SEQ ID NO: 141239 - DNA, 3263 bp, Homo sapiens
  Payload ID: 7745
  Gene Symbol: HOXA3
  Gene Name: homeobox A3
  Uniprot ID: O43365
  ENST ID: ENST00000396352
  CDS Start-End: 201-1532
tctcactagcctcagagcactctcagaagttcagaaactaagaccagaaaagagaagatttttagacagctcatgaaacggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaataatatccgtgttaagaaggggttctttggccgaagacgtgggtctgcgtggaattcaggccgaggcgagccggcagagcaggccggacgcagcagccctctggctccagcatggggcctggccaggctattcgcctggaagctcggcgaattctcaggatggcggctggggctccaggcggctgcggcagctctggtaacgccgtgcggcgggccagctgggctgcccggttcccagctgctgcggaggcaggctgagggcgcaggggctgccgagtgctgtgcacggaagaaacaaagacatcccggcccaaggcgcagcgggagcgcacaggtgccccgcggcccagccgggggataacgcagggcggtcttctgctccatgctcttcctcgggtcaaagcggaccaactaacgcctaaacctcggtattagccagccgcgcagaggatgccgagcactttccgggagcaatcggactcctggtctcctccggggatgcttcgcggtctgttatcgcgtcaggaggaaagaattgctccaaaaatctgcacgcggagcgaaacagtttgaaagggactgaggctcacccaggtctccagcaaacggaggactgaactggggagagtcaccctgagccagcccttccctggactgccggaatcccagcattagcttcctgctgaatgtagtatttggcattctctgaatttatttcctctccttcccccacccagctttctttttatggccccagggggagggggagagagcaaggagatcggtatctttgtaataaaactgcaattttataaatttttcatttgat

SEQ ID NO: 141240 - DNA, 581 bp, Homo sapiens
  Payload ID: 7745
  Gene Symbol: HOXA3
  Gene Name: homeobox A3
  ENST ID: ENST00000522788
  CDS Start-End: 329-581
tccatttgactcttttgcaggctacgtgtgccgcctggccattcaaactgtcaattttaggtccagaagtgtccaaaccacaagttctcaaaactctctgaaaaatggctccctccgagttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcc

SEQ ID NO: 141241 - DNA, 503 bp, Homo sapiens
  Payload ID: 7745
  Gene Symbol: HOXA3
  Gene Name: homeobox A3
  ENST ID: ENST00000522456
  CDS Start-End: 342-503
cccagtcggccctgggcgagccgtgctggagcagcgaggcggccacgctctgcgcggcggtgaccgggcctcggggtctccagcccgcctgccatctcggctgatgctgagggtccgtgcccatcccgcgccgaggggacccggccgggccgccaagccaggccgggggccagagcccgtgtcggagcctgagcccgagcctgcgctcgtcagaagttaaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtct

SEQ ID NO: 141242 - DNA, 3396 bp, Homo sapiens
  Payload ID: 7745
  Gene Symbol: HOXA3
  Gene Name: homeobox A3
  Uniprot ID: O43365
  ENST ID: ENST00000612286
  CDS Start-End: 340-1671
ttcttgcaaataatgtggtctcaggcaaggacacagcatcttggctgtctgctaaaaaaaaaaaatgcctagactctcagtggaaattgagtgtcaagctgcaaaatctcaaatggcagactatcatcatttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaataatatccgtgttaagaaggggttctttggccgaagacgtgggtctgcgtggaattcaggccgaggcgagccggcagagcaggccggacgcagcagccctctggctccagcatggggcctggccaggctattcgcctggaagctcggcgaattctcaggatggcggctggggctccaggcggctgcggcagctctggtaacgccgtgcggcgggccagctgggctgcccggttcccagctgctgcggaggcaggctgagggcgcaggggctgccgagtgctgtgcacggaagaaacaaagacatcccggcccaaggcgcagcgggagcgcacaggtgccccgcggcccagccgggggataacgcagggcggtcttctgctccatgctcttcctcgggtcaaagcggaccaactaacgcctaaacctcggtattagccagccgcgcagaggatgccgagcactttccgggagcaatcggactcctggtctcctccggggatgcttcgcggtctgttatcgcgtcaggaggaaagaattgctccaaaaatctgcacgcggagcgaaacagtttgaaagggactgaggctcacccaggtctccagcaaacggaggactgaactggggagagtcaccctgagccagcccttccctggactgccggaatcccagcattagcttcctgctgaatgtagtatttggcattctctgaatttatttcctctccttcccccacccagctttctttttatggccccagggggagggggagagagcaaggagatcggtatctttgtaataaaactgcaattttataaatttttca

SEQ ID NO: 141243 - DNA, 1747 bp, Homo sapiens
  Payload ID: 7746
  Gene Symbol: HOXA4
  Gene Name: homeobox A4
  Uniprot ID: Q00056
  ENST ID: ENST00000360046
  CDS Start-End: 67-1029
ggcctcggcaagcccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattca

SEQ ID NO: 141244 - DNA, 1595 bp, Homo sapiens
  Payload ID: 7746
  Gene Symbol: HOXA4
  Gene Name: homeobox A4
  Uniprot ID: Q00056
  ENST ID: ENST00000428284
  CDS Start-End: 1-963
atgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtgggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccattt

SEQ ID NO: 141245 - DNA, 982 bp, Homo sapiens
  Payload ID: 7746
  Gene Symbol: HOXA4
  Gene Name: homeobox A4
  ENST ID: ENST00000511914
  CDS Start-End: 1-421
caagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgt

SEQ ID NO: 141246 - DNA, 1728 bp, Homo sapiens
  Payload ID: 7746
  Gene Symbol: HOXA4
  Gene Name: homeobox A4
  Uniprot ID: Q00056
  ENST ID: ENST00000610970
  CDS Start-End: 48-1010
aaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattca

SEQ ID NO: 141247 - DNA, 1657 bp, Homo sapiens
  Payload ID: 7747
  Gene Symbol: HOXA5
  Gene Name: homeobox A5
  Uniprot ID: P20719
  ENST ID: ENST00000222726
  CDS Start-End: 62-874
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatgacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgtgtaattaatgctgttgtagaggtgacttgatgagacacaacttgttcgacgtgtagtgactagtgactctgtgatgaaaactgtgactccaagcggtgtgtccctgcgtgcctttataggaccctttgcacgaactctggaagtggctcttataagcgcagcttcagtgatgtatgtttttgtgaacaaagttacaaatattgtccaagtctggctgttttaagcaaactgtgatcagcttttttttttttttttttttttttgtatttgtttttaaggaaaaaatactgactggaacaaaaaataaactttctattgtaagttc

SEQ ID NO: 141248 - DNA, 989 bp, Homo sapiens
  Payload ID: 7748
  Gene Symbol: HOXA6
  Gene Name: homeobox A6
  Uniprot ID: P31267
  ENST ID: ENST00000222728
  CDS Start-End: 26-727
cacagtcctgcagaggggcgcgcaaatgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacaccca

SEQ ID NO: 141249 - DNA, 2018 bp, Homo sapiens
  Payload ID: 7749
  Gene Symbol: HOXA7
  Gene Name: homeobox A7
  Uniprot ID: P31268
  ENST ID: ENST00000242159
  CDS Start-End: 133-825
gtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctttgctcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaagcaacccagtccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactactacctactcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatgtacgccctgatgtttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaa

SEQ ID NO: 141250 - DNA, 585 bp, Homo sapiens
  Payload ID: 7749
  Gene Symbol: HOXA7
  Gene Name: homeobox A7
  ENST ID: ENST00000519842
  CDS Start-End: 494-585
gggcagtttatgaggcgtttaggggaagggttctccccaccatcctccaccgagcggtgggcggcaggggcttcagctggtgcaacatggtgcaggggtcggaggcctggaagggcggataaacagtgtgcctccgattaaggaaaggaagctgggagacgttgactttattcgaaccacatggctccagtttgcggtggcaatctctctgcagctgcaagagatgctgcgccttccccgtctggatccgagtctaagtccggcctgtcgcccactggacctgggcggctgcgggccctgcggagcgagaccacctgtgaggactgctgagattggcggaggcggtcatgtgggcggtcacgtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctt

SEQ ID NO: 141251 - DNA, 2060 bp, Homo sapiens
  Payload ID: 7750
  Gene Symbol: HOXA9
  Gene Name: homeobox A9
  Uniprot ID: P31269
  ENST ID: ENST00000343483
  CDS Start-End: 74-892
agttgttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttctattt

SEQ ID NO: 141252 - DNA, 797 bp, Homo sapiens
  Payload ID: 7750
  Gene Symbol: HOXA9
  Gene Name: homeobox A9
  ENST ID: ENST00000396345
  CDS Start-End: 70-390
gttacatgaaatctgcagtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctccctt

SEQ ID NO: 141253 - DNA, 4971 bp, Homo sapiens
  Payload ID: 7751
  Gene Symbol: HOMEZ
  Gene Name: homeobox and leucine zipper encoding
  Uniprot ID: Q8IX15
  ENST ID: ENST00000357460
  CDS Start-End: 166-1818
aacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggactacaggcacctgccaccacacccggctacttttttatatttttagtagagacgggtttcatcatgttagccaggatggtcttgatctcctgacctcatgatccgcccaccttggcctcccaaagtgctgggattataggcatgagccaccgtgcccggctattttcagttcttatgctgtgaccactttgccttgtagctttttctatctttccaaaatcctcactctgttcattgtttgtctcagggaaaatcttcccccaccgagcttgtaaaaaactttaataattgggtggagaataatttagaatggatatttattggaggtggtaattagggaagatgtccttttaaacagtagaattgtgttacaaaggggtgaaagagagggaatagtttctccttgttgaagggcagtgaaggtaggtttcaggtttggttttacaaacctgttaactacctcctgtccagcttgacagagactaatttttcatctttttgctgtcaatttgtttccagaaaagagacttttccctctcttgataggatctgtcttagggacagagggaccatcgtctttaagtgaattaattattgatgttttagaatggttttcatcagttgggatcagctatatggcaaataggtatcatcaatgagttaaccatctaaaaataaaagagtggaagccctaaaatgctagaataataataaaaaggccaaaaataaaattgtttctctctcaaccactttgccactcctatggtttagggattaatggaaccaaatccattaacattctaactcagcatacttttaacttattgtttggaggggcaggacttattgaggtaaattaaaagaacaaaaactgtaaaaaggaagtagttcagcatctatcgccagccaggttgtttctcagccatcaaatgataatgactaaaatttctgaggcttcaggagtaacagagatacaacagtcttggaggtaactccatttgctacaggacaggcccttgcctaaaagagaaggtatctagaaatgcctttaaaataaattcagagtaccagaaagggtatggggatcctagttcagatacaagatcattcccaagacctaatttatttctggcagatgcctgctattttctgtttttccagtatttttgcttaaggccagcttgtgagtggctaacctatttaattcgtcatttctgccttttaaaacccaaagtagaatacatgtttgatctcagtgatagtgttgttcgcccattccaccattctagagcttgtaaaagtgatagaattgtagcaataaaagggcatcgtctttattttactatctatatactaagctgaaaatcagtgtctccaacagttgttttcaatagaaaggaaaattaacatttaatagtaactaagcatagaggaaataatagacaaataaaaaagtataataaggaaaagaacagagatattgctcgttaacattggcaatgggacagtatatccaaagctaaaaatgaaatccagaaatgaaacagtgatgagtatatgatccatcacaatccccattcccaactcccaaccaagcatgatgccaagaattatttttttgacctttgttccaaattgtaggaaatgaggggagctaccagtgtcttctggaagagatataaacatcttcctgaagcactagccttttgtaagacctgaccactgtcctgggaggtgataagggtgaatagggtaaagatggggggagcataaggtacagagtgaaactaggaaacaatgcagggatacattttccagggccatcacccctaatgcgtactggaagctacagtccatccttcagcagcatgtatagatcagatcttgaagatgatctatctagaagtggtccatgcttctctcccactgggtaatcccatatgcctccgttgttggtagagagtctgcagcagaggacaagaaggtagatgtgggtgtttataacagcaaaaagggcaagcaagtctctctgacctgttgtatgaagcttatcgagacagacaccactgcttttgcttccccatagttttcttcattgcatgataactaacttttccaaactaggatttgctacatctagtgtgacaatctctggaacatttcagtagcttatggtgataataataaggatgaatatttgaaaattaaactattttggaaaatctgggacatatgactaccacacccagagatgactaccagggaggcagagttcttaggcctctgaggaggtggcatttccttcaataactttaaaattttttcacattttcggttgtttgtttgtttgtttgtttgttgtttt

SEQ ID NO: 141254 - DNA, 3337 bp, Homo sapiens
  Payload ID: 7751
  Gene Symbol: HOMEZ
  Gene Name: homeobox and leucine zipper encoding
  Uniprot ID: Q8IX15
  ENST ID: ENST00000561013
  CDS Start-End: 160-1818
ggaaaagaagcagttcctgatgttacaaatgaacaaggatctcccagggaagccctaccctgagaataacagatgcctcctcattacatcataatggccaagttgtgatgtcggcacagagaatttactcttcactaagtgttgtaagtgaaacaagatatgctgaagagcagaatcagcatgaggagcagacaccccaggagagctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggactacaggcacctgccaccacacccggctacttttttatatttttagtagagacgggtttcatcatgttagccaggatggtcttgatctcctgacctcatgatccgcccaccttggcctcccaaagtgctgggattataggcatgagccaccgtgcccggctattttcagttcttatgctgtgaccactttgccttgtagctttttctatctttccaaaatcctcactctgttcattgtttgtctcagggaaaatcttcccccaccgagcttgtaaaaaactttaataattgggtggagaataatttagaatggatatttattggaggtggtaattagggaagatgtccttttaaacagtagaattgtgttacaaaggggtgaaagagagggaatagtttctccttgttgaagggcagtgaaggtaggtttcaggtttggttttacaaacctgttaactacctcctgtccagcttgacagagactaatttttcatctttttgctgtcaatttgtttccagaaaagagacttttccctctcttgataggatctgtcttagggacagagggaccatcgtctttaagtgaattaattattgatgttttagaatggttttcatcagttgggatcagctatatggcaaataggtatcatcaatgagttaaccatctaaaaataaaagagtggaagccctaaaatgctagaataataataaaaaggccaaaaataaaa

SEQ ID NO: 141255 - DNA, 972 bp, Homo sapiens
  Payload ID: 7751
  Gene Symbol: HOMEZ
  Gene Name: homeobox and leucine zipper encoding
  ENST ID: ENST00000606731
  CDS Start-End: 1-972
cagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcag

SEQ ID NO: 141256 - DNA, 2020 bp, Homo sapiens
  Payload ID: 7752
  Gene Symbol: HOXB1
  Gene Name: homeobox B1
  Uniprot ID: P14653
  ENST ID: ENST00000239174
  CDS Start-End: 94-999
attcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttattcggttcagtgccttcgagctttgaggagtctcctcacgcactcttatcctaactcccccttctaggcctgacacagaaccttaaattttcttgtgtgggaggtgtttgggtgcagccatattattatcaatgcttaatccagtcaccacagaccttacaatagcaccagctgccttgtgacagaccaaaaagccccccgcccccatctaaccccattagccctctcctggcatatttatattgcactaatgcagccttcagaggttgttttctgagacctgcctcctcacaccagcgacctcatcactatgtcaccaaagtgttttggaacttggtattccagagacttctggaacgccgtgcaaggcctgcccccagcaagccacaaccaggaaggtgcaggcacgcccccactagctcctcccctatttattgcctcctggaaaacccaggaccctcttccccatctccacccctacccctgggggcagcccagggagagccaggcacaatgagggctcccaacagctgcaaggatttatctgaacctttgagaaagaggaggagccatctaagtttctggaaacctgagccccaagtgagcccgggttctctctgtacctgcaactacctcatttcaataaagtctgtgttttcccttc

SEQ ID NO: 141257 - DNA, 1414 bp, Homo sapiens
  Payload ID: 7752
  Gene Symbol: HOXB1
  Gene Name: homeobox B1
  Uniprot ID: P14653
  ENST ID: ENST00000577092
  CDS Start-End: 7-705
tgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacaggtagggctcagatgtggccaccccttctccggggcccaaagcatctctgcttcccctgcagtgacatgtcctgggtctgggctgggttcttctctttcagcggctctggtagacacaggtaagagcacaacctacgtctcaggtcaggtgaggtctccccacccagtatgtaaccggtcaccccaggagtaagtttccatacacaccccacttcctgatctgtgcacccagcacagacccaggacctggtgtgcatgggggatggaagtatggggaaggctgctccagacttggtgatcaccatgggggtacctggtggtccctgggaactttgacaactgtacttgggcagaatggcaaatggaggtccagagccagccccgggaggagggaagcggaaggagaaagaggtgagagaattgacctggcctttctccctgccccgcccctagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtcc

SEQ ID NO: 141258 - DNA, 3467 bp, Homo sapiens
  Payload ID: 7753
  Gene Symbol: HOXB13
  Gene Name: homeobox B13
  Uniprot ID: Q92826
  ENST ID: ENST00000290295
  CDS Start-End: 586-1440
aggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaa

SEQ ID NO: 141259 - DNA, 1562 bp, Homo sapiens
  Payload ID: 7754
  Gene Symbol: HOXB2
  Gene Name: homeobox B2
  Uniprot ID: P14652
  ENST ID: ENST00000330070
  CDS Start-End: 79-1149
gggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaa

SEQ ID NO: 141260 - DNA, 2642 bp, Homo sapiens
  Payload ID: 7755
  Gene Symbol: HOXB3
  Gene Name: homeobox B3
  Uniprot ID: P14651
  ENST ID: ENST00000311626
  CDS Start-End: 898-2193
ttttgcattcctccagcttgcagctccggtagttggaggctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctaagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatccttt

SEQ ID NO: 141261 - DNA, 4208 bp, Homo sapiens
  Payload ID: 7755
  Gene Symbol: HOXB3
  Gene Name: homeobox B3
  Uniprot ID: P14651
  ENST ID: ENST00000470495
  CDS Start-End: 1449-2744
ggagttgaacagctaggctgaatgagattaaagttttccaaacacacatggcagtatggaggttttatgaaaagtgatggtgaagagttgggagagatggagggaaaaaaatgcagtcagaagtttcagaacaaatacacaaaatcctatgttagtttgaatctttatttttctggcacacttttaaaaggctgtattaaaatagtgattttttttttttgcctcagggaacctcagtcaacaggaatacctctgtttctaacctagagaataatattgttaaaattgctttgttaatttttttttcctcaggaataattttctcttttggaaagcactttccccgtctcagtagaaaagtctagcagttgtaacttcttgtttcttatttgctttgggggaaatcaaagaaaacagacggtgaaggaaagggtgggaaaaattaagtctcatgaaaaaaaaaaaaagaggtccggggagagacctgggccaaatggtcacagcaccaactggcgtggcccaggaaattgaaacaatcctgctccatgtgggggccccacagggccactggctgcccgatcccaggtttggctgagcaaagacaagggctggaggtggtggtacctgcagcagggccatggacagatgagtctcggttcagctggctcttgaggttaaaaatcatcaggaagtttctaggtcaggctgttgttgtcttcctggtgggagagtggtgggaagtggagaggatacctcacaagagaagcttctctgctgaacttgcttctcctgcctgttcttttaggagatcctttggttttccttcaggctagactttgcttgggcaagagacctaaaccgacttggaaggaggcaaaggctggaagcatagaagcctctgggctcagaggagggtgttgatgatgcttttattttggagtctcctagtgtcccctcccttgagccatcctatcccagagttggggaggagagatagggagagagggactaggggaggtcaggggctagtgcacaggcaggagagaagcaatggcctttgccatagattctacatctaggcagtcttgaaaggcatatagtctttatttatttttttattttttagtggaaatgaaaactggtgggcttttttttctcagcatctgctttggagatgttggggaggggaaaagaaaaaaccctattgatgtcagttcccttttcagttcctaagatggattcgagccccagtcctcttctcccccttgtgtctcttctctcgcctcgcaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaaatttgttcccatttgaggtttattgaggtacacttctagcccccggtttttctgctctagaacattcatatctatacatcccacccccatcaattacagtttttagagggctcagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtcccaggcaggggctgggcagggcctgtgtgccttgctcagcctcctgacaggacacttttgttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaatttta

SEQ ID NO: 141262 - DNA, 565 bp, Homo sapiens
  Payload ID: 7755
  Gene Symbol: HOXB3
  Gene Name: homeobox B3
  ENST ID: ENST00000471459
  CDS Start-End: 296-565
agagactgggcctggagactggagggagatttgggaggaatagagagggtgtagtggagggaagaagccggggctggagactcagaaggagggagccagagtgaggggagatttgtcgcctgccgctcgctctggggctcgatgtgaatatatattatgtctgcctgttctcccctcgtcggtggctaaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcgga

SEQ ID NO: 141263 - DNA, 1525 bp, Homo sapiens
  Payload ID: 7755
  Gene Symbol: HOXB3
  Gene Name: homeobox B3
  Uniprot ID: P14651
  ENST ID: ENST00000460160
  CDS Start-End: 559-1458
actttaactgctcgctgtggtggggaagggggcagaggtaggtgagcactctcccagcctggagcagccggaccagcccagaaggcagcggcggcccaggccagcattcccgcagacacaagaggcttaagtacggcaaagcctttcatatcgtgatttatttgtcataagcaaataaaatgcggttaagctgtctccttttagacagaaggctctttggttattaaagttccgagagaggattccatgaggctggcctctttcctcgcagcataagaagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaa

SEQ ID NO: 141264 - DNA, 1845 bp, Homo sapiens
  Payload ID: 7755
  Gene Symbol: HOXB3
  Gene Name: homeobox B3
  Uniprot ID: P14651
  ENST ID: ENST00000489475
  CDS Start-End: 703-1779
atagtaactgcctgctcgtgggggaggctgggagagaggtgaaccgcaggtcacggcgtctaaaaattattaaaatgtttgagagcctcgtgacgcgcctagctgtttaacaaagactgccaaagtatgagattaacacgaaaacttgcgcttccaaaacaaaaacacaccaaaaaaaaaagtcacgttccggcttctgagggagcccgtggctgtgtccgccgccgcggtccggttttccggacacacaatagtggacaggagagagctcagctgttgcccggcgcgtccgcgggcggctcggcggccggcggggctggggagcctcccgcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggca

SEQ ID NO: 141265 - DNA, 1420 bp, Homo sapiens
  Payload ID: 7755
  Gene Symbol: HOXB3
  Gene Name: homeobox B3
  Uniprot ID: P14651
  ENST ID: ENST00000476342
  CDS Start-End: 125-1420
ttaactgctcgctgtggtggggaagggggcagaggtaggtgagcactctcccagcctggagcagccggaccagcccagaaggcagcggcggcccaggccagcattcccgcagcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtga

SEQ ID NO: 141266 - DNA, 1909 bp, Homo sapiens
  Payload ID: 7755
  Gene Symbol: HOXB3
  Gene Name: homeobox B3
  Uniprot ID: P14651
  ENST ID: ENST00000472863
  CDS Start-End: 311-1387
gacactttaactgctcgctgtggtggggaagggggcagaggtaggtgagcactctcccagcctggagcagccggaccagcccagaaggcagcggcggcccaggccagcattcccgcagaggggagatttgtcgcctgccgctcgctctggggctcgatgtgaatatatattatgtctgcctgttctcccctcgtcggtggctaaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaa

SEQ ID NO: 141267 - DNA, 2196 bp, Homo sapiens
  Payload ID: 7755
  Gene Symbol: HOXB3
  Gene Name: homeobox B3
  Uniprot ID: P14651
  ENST ID: ENST00000498678
  CDS Start-End: 573-1868
agtatatttcacattctccagaatgttaagtgacactttaactgctcgctgtggtggggaagggggcagaggtaggtgagcactctcccagcctggagcagccggaccagcccagaaggcagcggcggcccaggccagcattcccgcacaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcag

SEQ ID NO: 141268 - DNA, 943 bp, Homo sapiens
  Payload ID: 7755
  Gene Symbol: HOXB3
  Gene Name: homeobox B3
  ENST ID: ENST00000465120
  CDS Start-End: 251-610
caaagggatgtgagatttctattcgccgcggaggcggcgacaattagaacgtctcggacccatggcggggcggccattggctcggaggatcacgtgggcgcctaactttgttcacttgacacaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggcctcggcgccctccaacccggagccctgctgagcaaagtcccgaagcggagtttctaaggcgccttttaattcggttacctccagctcccaaaacttgctgccgcccgcggggctcggccctcggccggctggtgtgctgggaacctgcctccgataaccgttttggtgtcctgatcgcttgctcttcttcgcctccttgggccatcgtaggtggctggtagcttgtcgccagtcgccgcggcagcagcgaccggctgaggcagcctggcagcagcagccagggactacccgggtgcacaaaccttcccagccctgtctgcaccaccggcggagtctccattctttcctatcgcgtctctggctccttcgctttccacactcgcctggcctccgtcccgcgatggtttggggtttattgcaaggggagcggcaggaatttcggccccaggcatctagttaaattattgttttattattattactatcatcatcatcgtcatcattattattgctgtaacaatcagactaaataaagccagggcctagccagccaa

SEQ ID NO: 141269 - DNA, 1109 bp, Homo sapiens
  Payload ID: 7755
  Gene Symbol: HOXB3
  Gene Name: homeobox B3
  ENST ID: ENST00000490677
  CDS Start-End: 139-1032
attcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtc

SEQ ID NO: 141270 - DNA, 3757 bp, Homo sapiens
  Payload ID: 7756
  Gene Symbol: HOXB4
  Gene Name: homeobox B4
  Uniprot ID: P17483
  ENST ID: ENST00000332503
  CDS Start-End: 1793-2548
gagaattgaaaaccttgtaatcccaagaacagactcgcactgcctttttctgttcccagagctcaaaactagaacaaaacgaaataaaaccaaagcactcaaaccacaccccaaacgaagaaggcgcggaaagtaggagaactggaaaatttctgggccaagaagatctgtctgtcttctgtatataccctgtagatccgaatttgtgtaaggaattttgtggtcacaaattcgtatctaggggaatatgtagttgacataaacactccgctcttatttttccagaagaaaaaaatatatatatatgtatatgtagtatttttctgaatgaggacagtctggtgactggccacacgaagactccttcctctttattcctctatcttttcctccttcaactggttagagatggagaaatcatctacctgaactctccccacgcctgcccctgggagccttggtcccttttcacatctctttaagaggttaatgttattgttgttgaagttttaaatttatcttctcgtcccaaacgcacccattttctattctgggctcagggaggctttattggaaattgcgaaaaaaaatgacttgtcttcagtgtgcgaagaaggcaaaggaaatttgtttaacaaacggatgctgaggccgcctttccgtttcagttcagaacaagatgacctggaaatactcgattaccaaggagtgttattgtctgtgtgggtcacctctatggctgtatccccagtatcaaagggatgtgagatttctattcgccgcggaggcggcgacaattagaacgtctcggacccatggttagtattgctcgggtggttatggaattagcaaattgctaatcaattttgctctcaaaagttgcaggtttttttaccccagcgctctgtctatagtgtgggaaaccaagtcgtttctccaggcttgggccgtgtgggttaaagggaggagtggataggagaagggggacagacggactgacggacacagtctagctaaccgtgcagctaaatgagatttggaaggcgaagtctccccgaattagtgcatgaatttcctatcgatccgcccgcggttccattcatctctgacaagtccctctgcgcacccgccctctagctctggacgcctcctctctcacccctacccttccccatccagctgcagagaaaagccccaagctctgtgctctggcccccgtatgggttcccctttcgagacggagcccccaacccgccagtaacctaactccccatagagacgcagggtgctagcgctccctcccgccgaggggaggagactggggcctttggaaggtacagaatgctgggcagaggtgaggcagaacaggagggctacaccgggagccccaacttcttaagggatctagggtttgcgctctgcctagcgccccaacaggccctccagtcgcaacctgcgcgcgctctctctctcgctctctctctgatcccggagagagcgaggcaaggagggggtcgccccgcaggagccctatgtaaatcctggtgttgggtgggtgggtggggagggggaagggaagaaggggaaataaacctctttggctggagtggggtccgggtgagcagatttccttatccgggaatcgcaggcggggcggccattggctcggaggatcacgtgggcgcctaactttgttcacttgacagtaagtaggagggctttcggaaacaggaaaacgagtcaggggtcggaataaattttagtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggcccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcaggaaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtga

SEQ ID NO: 141271 - DNA, 2041 bp, Homo sapiens
  Payload ID: 7757
  Gene Symbol: HOXB5
  Gene Name: homeobox B5
  Uniprot ID: P09067
  ENST ID: ENST00000239151
  CDS Start-End: 280-1089
cattgaatcggccctaacgattctcggatcgtcattatttgtaaccatagagcatgaattacctcttgaggtcatcagcgagaatttacgactggtcaacaaaagcacgtgattccctaacgccccccaccccccttccaaccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcaaatattcccctggatgaggaagcttcacatcagccatgatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttggtcttaggtcttcctgtggctccctctctcctggactggttatcttgttattattgttaataataattattattattattttccttccatgctcccaactcccttctgcttgtcccaaatccgccagtgtttctgaatgtttgtgtctgtggttgcagtctttcccccaggaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactcca

SEQ ID NO: 141272 - DNA, 1660 bp, Homo sapiens
  Payload ID: 7758
  Gene Symbol: HOXB6
  Gene Name: homeobox B6
  Uniprot ID: P17509
  ENST ID: ENST00000225648
  CDS Start-End: 326-1000
caccacacctaggtcggagcactgtcgtccttcagggctccagcctcttgatatttttgtacttcagtatcagctcgatagagcaaaagagagagaggacgagagagggggtcagagaaggggaagcaacggctctcacgttgggacaatattatctggaagctgaagaagaaactgaatactccttccttcctccccacccattcctttaaatccggagggggaaaaaatcccaaggtctgcaaaggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactc

SEQ ID NO: 141273 - DNA, 1960 bp, Homo sapiens
  Payload ID: 7758
  Gene Symbol: HOXB6
  Gene Name: homeobox B6
  Uniprot ID: P17509
  ENST ID: ENST00000484302
  CDS Start-End: 624-1298
taatgcagcattcttttggacaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcctccccacccattcctttaaatccggagggggaaaaaatcccaaggtctgcaaagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcga

SEQ ID NO: 141274 - DNA, 1371 bp, Homo sapiens
  Payload ID: 7759
  Gene Symbol: HOXB7
  Gene Name: homeobox B7
  Uniprot ID: P09629
  ENST ID: ENST00000239165
  CDS Start-End: 103-756
gtcctttttggtgtaaatctggactctaattctgtaatatatcaaggaatctcgtaaaaccgacactaaaacgtccctgcctacaaatcatccggccaaattatgagttcattgtattatgcgaatactttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaacagat

SEQ ID NO: 141275 - DNA, 1823 bp, Homo sapiens
  Payload ID: 7760
  Gene Symbol: HOXB8
  Gene Name: homeobox B8
  Uniprot ID: P17481
  ENST ID: ENST00000239144
  CDS Start-End: 236-967
ccttttctattcctggaaaccacaaaaagtgtgtcggcttcgagatcttcttcgccttttctttcttttctttttttccctcctctctttccctctcctttcctggcgagggtgactaggagccggcgaatccgcgtttttttctctctctccctccctttccccctccccaccccctccccaacagcccccaactatagcctccgccgccgccgccgcctcaaaattcaataaaatgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccga

SEQ ID NO: 141276 - DNA, 502 bp, Homo sapiens
  Payload ID: 7760
  Gene Symbol: HOXB8
  Gene Name: homeobox B8
  ENST ID: ENST00000498634
  CDS Start-End: 1-386
cctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaaaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccaccca

SEQ ID NO: 141277 - DNA, 743 bp, Homo sapiens
  Payload ID: 7760
  Gene Symbol: HOXB8
  Gene Name: homeobox B8
  ENST ID: ENST00000576562
  CDS Start-End: 1-729
atgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggac

SEQ ID NO: 141278 - DNA, 2581 bp, Homo sapiens
  Payload ID: 7761
  Gene Symbol: HOXB9
  Gene Name: homeobox B9
  Uniprot ID: P17482
  ENST ID: ENST00000311177
  CDS Start-End: 88-840
accggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaat

SEQ ID NO: 141279 - DNA, 1936 bp, Homo sapiens
  Payload ID: 7762
  Gene Symbol: HOXC10
  Gene Name: homeobox C10
  Uniprot ID: Q9NYD6
  ENST ID: ENST00000303460
  CDS Start-End: 75-1103
tcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaagccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 141280 - DNA, 526 bp, Homo sapiens
  Payload ID: 7762
  Gene Symbol: HOXC10
  Gene Name: homeobox C10
  ENST ID: ENST00000515593
  CDS Start-End: 145-526
attttcaaatcccattggtctagccgtcacatgctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgact

SEQ ID NO: 141281 - DNA, 2039 bp, Homo sapiens
  Payload ID: 7763
  Gene Symbol: HOXC11
  Gene Name: homeobox C11
  ENST ID: ENST00000243082
  CDS Start-End: 115-1251
gctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccagtagacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaa

SEQ ID NO: 141282 - DNA, 3261 bp, Homo sapiens
  Payload ID: 7763
  Gene Symbol: HOXC11
  Gene Name: homeobox C11
  Uniprot ID: O43248
  ENST ID: ENST00000546378
  CDS Start-End: 117-1031
gtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccaacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaatattatgattttatttgacccttttattaacccctctcctcttaaaatcctccatgctcccatggcagcggcggaggaggaggaggcaggcaggcagagcccagcgggtgaggacaggcaggcagaggtgagataggccggtgctagccggcctggagctcctctccgctggcagggccaagagtatggccgtagtctcctcacattctcaagctgaggacattccatagctactctgaagctctcctttctcacgtgcagctcgagctgtgtccaaacgcccagcaacggctttctgtttaagtacacgtttgttgtggagttaattgtaaccatcatcgaatttaaatttataggaatttttttggctccaccgcccttctgccagatgtctccgtctgtcgcagttaaatgtgtagtgtggaggttagggcttttttttttttttctctaggagaaatctgtattggaatttttatacactgtttttaaggaaggaggggacagaaggagaaaccagccccctccctctcctctccacagctcctgggggtgggaaggtggggcctggctgctttccctctggcacaaatggccaggctcttccagacacaacaagacgcctatactggggccaccctgatgtttatacattgggtgtcccacagtagaaagccccagaggtttgttttgtaggggttggcactggggatggagatgacctgcggggacagtcaccatacccatctatatttgctgcatgtttcttctgtataaagataatcatggcccttgcagtgctttcagtgagggcacttcgttggtctctgtttcaaattcgttatttgggggcagaggttcaggacaactcatctcatctttccctcctctttctgtctttgtataattcaaagaaaatatttttgtcaatacaattctgttggatgaaaggaaaaagcatcatgactatcaaatctaggttctgtcatttttgatggtaggaatccctgcagcttaggtatctaaatttctaatttgtaaacgtgggtcgggtcgtgagacaagatttgcaaactagggtgtatatgcagcccacaattccctcatgtgcccacacacaaacgttttatttaactcggtgtgcctatgggtgcacataagaaggaatattatttatatgcttttgtctgttgcatggagtaaacctgaccacatacacatcta

SEQ ID NO: 141283 - DNA, 3335 bp, Homo sapiens
  Payload ID: 7764
  Gene Symbol: HOXC12
  Gene Name: homeobox C12
  Uniprot ID: P31275
  ENST ID: ENST00000243103
  CDS Start-End: 97-945
cgtgagtggggcggccaatgggtgactggtgcagatttaactatgtttaatgtcagatagcaataaagtagaagctgccggtcgggccccgcggaaatgggcgagcataatctcctgaatcccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcagcgctgctcccgctggagccgtcggggccgcctgcgctcggcttcaagtacgactacgcggcgggcggcggcggtggcgacggcggcggcggcgcaggacctccgcacgacccgccctcctgccagtcgctggaatccgactccagttcgtccctgctcaacgagggcaacaagggcgccggcgcaggcgaccccggcagcttggtatcgccgttgaaccccggcggcgggctctcggccagcggcgcgccctggtacccgatcaacagccgctctcggaagaagcgcaagccctattcgaagttgcaactggcagagctggagggcgagtttctggtcaacgagttcatcacacgccagcgccggagggaactctcagaccgcttgaatcttagtgaccagcaggtcaagatctggtttcagaaccggagaatgaaaaagaaaagacttctgttgagggagcaagctctctccttcttttaaggtgcaggacacgggcgccagccccagactgagcctgtccctggcagagagcaaaagagggcgccgcctagaacacagtccccacttagaacgccaggcgtctctggcaggccctccctggatatcctcttgtctgttttgttcgtggttccctcccatacacacccaaaacaccctgccaggtcccagagagaagggaagaaacctagccagggagagcagaagccggcagctgcctgcggttggcaggggcaggaaggctgaggtgctgcgggctggtttatttgaggcaggactggggcactgcacctccgctgaggatctggagaagcagcggcccagatgtccccttcctctacttcccttccatggtcttaattctctttgccgtcaggagcaaagagcagggccagtggaaccaaggcacctcaacctcacagttcctggggttagaagaggctgggaagagagaggagggtggagggtcagcggagagagctgagggagtcaggtgtctctggtagggctggaggaagtggggaaccaaggaggaagtgtggtttgtgagaaaatgattagcaagaaccagagtctgcttgggtctgggtcccccaggacacccagtgggcagaagcttgggcatttggctggccgggctgtggacaaggactatcagcctcatgttccctctaggaccagaacagtgtcctggtccccagccctctcctgatcccgctgcccgcaccgggcgaatgtctgttcataggtgtgctgccatccactcctccgttgcctgcggtggctgcaggcctgatgcagcaagcagggacctgagagcccaggggacacagcctcaggttcagtagccaccccagaggtccccagctggctctccagaaagaaagtgcaagaggctgtagatggggctacggagcaccacactgattggccgggagaatttctgacagccacagccgaggcctctgattctcccttccccgctggcgttcacggtcactgcctcacgggccggccagagggtggaccagcgtaatttacgaggcgggaggagaattcacccttaaaggggctaccagccattgaggtcccactcagccccagtttcccaggcccgtgagaatgaaggaggggggcgctccagccccccacccaactcccttctctcttcctcgcccgccccccaacattgccctttgtcttcagaagggctgcctccgcctcctggcctgcaaacctccacagcctagcacatggaccagagcagagggaggggcacagccctagaacccattggaggtctgagaatggcttctctgagtgggaaggactttcatccagactccttcagaccccagccccagcccagtagacgctgggctggcttggaagagaggagcagtgagagaaccatcaacctttctgtacttcatttttatccttctccccaagagtcccccagcctcccatctgctgtccggccctttccaggagcaagaggggtgagaagcagggcactgatgggagttaactgcagcctggacagtgtgaaactggcctgctggcttggagtgtttcccatatggggagagtctcccctaacaaactctccaaaggcaatccaccgagctttttactctcccaccagcacacagcttctgtacaggcagaggcaaaggcaaacacatacacacagctgagcccagcacagcactgggcccaccccactctccctagtgcactcgcaagcaggcagcctcataatccccacatggcccagcagaatggagataaaatcacatgcctccatcccccgctgggtatctgacacctgacaattccccatccacacatacttgcttcacccatgtacaagttcccccaaattaccaccattccagctgtctgcagtctcctgtggtcttcccctgggcatgaagcactccccaccttgactggtcacccactgtaccccctttatgcagcccttcctgtgacctctgggctctagggtgctggatttgagctctaccactccagactaacctgattcccaatctaataatgaagagggaccagaacactctaaaaggagtgaggggacaaagatatgcaatattctctttccatttgctttaaacttgacttctgtgaggttctctgtcaatctgtgtcttgttctctgtgtctgtcgctggtacctagtgtagtccctgtggatagttgcccttcccctagctgcctccccagctctctgtagtgtaattctcctattccaacgtctgtctttagcacgttttccctttatatagtccttgtacagagttgcttcatcatattaatattgataataataataattaaaacatgaa

SEQ ID NO: 141284 - DNA, 2423 bp, Homo sapiens
  Payload ID: 7765
  Gene Symbol: HOXC13
  Gene Name: homeobox C13
  Uniprot ID: P31276
  ENST ID: ENST00000243056
  CDS Start-End: 143-1135
gggaggtggaagcactaggaggaggggaggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttga

SEQ ID NO: 141285 - DNA, 1524 bp, Homo sapiens
  Payload ID: 7766
  Gene Symbol: HOXC4
  Gene Name: homeobox C4
  Uniprot ID: P09017
  ENST ID: ENST00000303406
  CDS Start-End: 608-1402
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgcgggggctcaacccccagacctccagaaatgacgtcagaatcatttgcatcccgctgcctctacctgcctggtccagctgggaccctgcctcgccggccgcatggccagagggttggaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctct

SEQ ID NO: 141286 - DNA, 1666 bp, Homo sapiens
  Payload ID: 7766
  Gene Symbol: HOXC4
  Gene Name: homeobox C4
  Uniprot ID: P09017
  ENST ID: ENST00000430889
  CDS Start-End: 47-841
agaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgaggacagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagtttta

SEQ ID NO: 141287 - DNA, 1805 bp, Homo sapiens
  Payload ID: 7767
  Gene Symbol: HOXC5
  Gene Name: homeobox C5
  Uniprot ID: Q00444
  ENST ID: ENST00000312492
  CDS Start-End: 271-939
ggttgggctttgccaacatatcgagatgcttttcgccggcttccatcactaacctcccggaggtcatcaagccaaatttatgagtggccgctcgagtcacgtgactctatttaaggctcccttatttgggaagagcgcataggataaagaaagagatatctccacctataaattgtccactttggagaacaaaaaacccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggact

SEQ ID NO: 141288 - DNA, 1733 bp, Homo sapiens
  Payload ID: 7768
  Gene Symbol: HOXC6
  Gene Name: homeobox C6
  Uniprot ID: P09630
  ENST ID: ENST00000243108
  CDS Start-End: 165-872
ttcctgacatctggcttgcgattggctgggagggggtcagctgactttgtcattttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaacttta

SEQ ID NO: 141289 - DNA, 2943 bp, Homo sapiens
  Payload ID: 7768
  Gene Symbol: HOXC6
  Gene Name: homeobox C6
  Uniprot ID: P09630
  ENST ID: ENST00000394331
  CDS Start-End: 1711-2172
acattgaatcaggaaatttttctgagaaaggcaggtgggtatgggcaatctgacacgatccaaaaggcttactgccttgcacccctccccgcaaaaaggaagtagagaccaagatcttgggctttaattttatttttaattgtaaaaagatttcaaataagccaccatttgaactgggaagggaaactagggatggtcttgggggaaaatgtcattctctctaagaaagggaccccggggatgtgggtcgttttgagggtcctagaagttgaccccaattctcacctctcctgctgcactgcaggattgcccagggtaggtctagtcccctaggttcttcagaccactccaggtcaggtttggttgggtggctgccagtggtcttccactactgttcctgtctagggtggagtaggagctttcaggggtacggcatagaggggatgttgttctcttactaaaaaaaaaaaaaaaaaaaaaaggtaggggtagggaggcaccctttcaatccctgcaattcaccagccatcactgcctcaaggccacaaatctttgcaaagctttgaattccgcctgatccaaccttaatgcccccatttattaaggacaatatttaaaactcggcaagccaggagaggcaaccgaccctcagtgcttgaagctttctttcgcctgggcgtccgccctcagctctttctgcgctcgcctgcagcagcctggcccgtggggagtgggcggtgggtgggggtaggggtggggtgggggtccggggatgctccctctatgagagaattgggtaaacatggcgaccgcggcgcccatttgcacacgctacacaaatgcatcgcattcccggttgtttgcagaaaatttacagctgagtaataaaagtttacgatcgactcacaagttggattggccacaagaagtcatgtggattccatccatgaacgtgaactttttattgtggtttgtccgttccgagcgctccgcagaacagtcctccctgtaagagcctaaccattgccagggaaacctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaat

SEQ ID NO: 141290 - DNA, 358 bp, Homo sapiens
  Payload ID: 7768
  Gene Symbol: HOXC6
  Gene Name: homeobox C6
  ENST ID: ENST00000509328
  CDS Start-End: 146-358
aagcgggattggaccaaaccagagggacagagtcttctgggtctctctgcctgaggccctggagggagagaaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtgtgtgttttgtgcccggatctttaggggtcggctacggagcggaccggaggcgcggccgc

SEQ ID NO: 141291 - DNA, 538 bp, Homo sapiens
  Payload ID: 7768
  Gene Symbol: HOXC6
  Gene Name: homeobox C6
  ENST ID: ENST00000504315
  CDS Start-End: 384-538
cggatctgattgcctggggtgctgggctgggcgcaccccactgctgctgggggtcaccccaagagccccccacccatccaaggaaaggaataaacttaaccgctggaggggcatgaggagctcagcccccccaacctcgacagcagctaacagaaacgccaggagcagcaggaggaggaggcagcgacaaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtgg

SEQ ID NO: 141292 - DNA, 1889 bp, Homo sapiens
  Payload ID: 7769
  Gene Symbol: HOXC8
  Gene Name: homeobox C8
  Uniprot ID: P31273
  ENST ID: ENST00000040584
  CDS Start-End: 180-908
gccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccagcatgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacgctccggggaggcgcagtggacggcaaacttacagccggtatcagaccttggaactagaaaaggagtttctctttaatccttatttgacacgaaaacgtcggattgaagtctctcatgccctgggactgaccgagagacaagtgaagatctggttccagaaccgaaggatgaagtggaaaaaggagaacaacaaggataaactgccgggagcccgagatgaggagaaggtggaggaagaaggaaatgaggaagaggagaaagaagaggaggaaaaggaagaaaacaaggactaagcaaaaaagaaagacccccccccccttagcaactcccttgaagtttcgttttatggtagcagataaattgagaagtttacgactgtcatttgcttttatagagaatagaatgacactcacaactctaactacctgtcagatacttgcagctctggttttattacctttggacttcccccactctttatttgtttgggggctggaggggggagacggagaaacagtgaaaagttcggactctctgtctcactccttgccccacacacacttgtccctgcccccacccttctgagtccttcctggattttaaggtctgagacctggcctccgtgctcctcggtctgtctctcaccacactcccacctccctgcttctctggtatttattttagaggggagccccctcgaaatgcagaaaaggacttgtggttttgtttttatgctaaggctagtgtactagatgtactttttctaaaaaggaaaggacagaaaaaaatgaagaaaggaaaggaagacaaatgtaaagaaataaggaaaaaagcaaggaatatcccctccccctccccctccccctccccagggctccctgcttagaaaaacccccttgactttctctaggaacctgatggaaacctgaaggagatgtgggtctttcccctccccccatttccagaagggtagataggagcctgcagtcgcctctaaaatcctacctaaccatcccatggtcactcgggcccatgccttcctctccttcgctgtttgatttctattctgttgggcccgccttcctctgagctgcattagtgttagtgctcagaaatcaccataatcacgaaaataataataataaatctttaacatactacctaaagggaacctgcaataatcttgaaaaagaaaaagagaaaaattttaaaatcctgctataggagaaaaaaagagaaaaaaataaaaatcaaaaaaaaaaaaaagaaagaaa

SEQ ID NO: 141293 - DNA, 1516 bp, Homo sapiens
  Payload ID: 7770
  Gene Symbol: HOXC9
  Gene Name: homeobox C9
  Uniprot ID: P31274
  ENST ID: ENST00000303450
  CDS Start-End: 71-853
gttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaacagccctgtgttaatatattgaagtcacttaaccagaaa

SEQ ID NO: 141294 - DNA, 1505 bp, Homo sapiens
  Payload ID: 7770
  Gene Symbol: HOXC9
  Gene Name: homeobox C9
  Uniprot ID: P31274
  ENST ID: ENST00000508190
  CDS Start-End: 99-881
tgcaaatttccttgcgacacatacatcacacaaaagatcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagcaaccccgtggccaactggattcacgcccgctccacgaggaagaagcgctgcccctacaccaagtaccagacgctggaactggagaaggagtttctcttcaatatgtatttaaccagggaccgtcggtatgaggtggcccgggttctcaatctcaccgagcggcaggtcaaaatctggtttcagaatcgaaggatgaagatgaaaaagatgaataaagagaaaaccgacaaggagcagtcctaaaccctacccagcctgctgcctcagcacagccaagggaaaaacaaaaaccccacaaaataccccaacacaggcgggggagagacgaaaaagaaaaggaaagagcaagatagacaaaagccaatcagcttaaaaagaaaaacaaggaaggggaaaagaaaactcttgcgatttgggagggttcagtgttgagatattggtgttttagagttagttctacccagcgaggaggaggcggggagagaaactgcgttctctttccccagcgcaaccgaaataaatgacacatacaaatgtgatttttttcctcctttcttcagagaagccagtacttgaatcgctatatttctatttttttttccctgtatcgtatttggtccaggtcatccctccccgggcctggggcgctctgcgtgcagattttgtacaaaaaaaaaaaagacacacacacatacatgataatgattcccagcccaggagctgaggggtgagggctggggaccatgccgcgggctaggtcgggcccgtgcaggccggcgccttgggctgtacatagtgttccctctcatccccagggttcgtccccagcgtccgtcctgtaacgtgcttctgtttgttatggtagaa

SEQ ID NO: 141295 - DNA, 3184 bp, Homo sapiens
  Payload ID: 7771
  Gene Symbol: HMBOX1
  Gene Name: homeobox containing 1
  Uniprot ID: Q6NT76
  ENST ID: ENST00000287701
  CDS Start-End: 343-1605
tgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaaga

SEQ ID NO: 141296 - DNA, 4082 bp, Homo sapiens
  Payload ID: 7771
  Gene Symbol: HMBOX1
  Gene Name: homeobox containing 1
  Uniprot ID: Q6NT76
  ENST ID: ENST00000397358
  CDS Start-End: 705-1967
aatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgaggtgagtcgagcggttttgaagccggactacctcaagtctctttcctcacttctttctcttcacttaaaacaatttttttggaggggttttggggaggaagtgagcggacgctggggatgggtctcgtaagcggccggattgagaggagggaggaagcagggggcttccgagtgggtgacccagacgcgggctgtggggtggggcagttcgtggggtccggtcctggaaaggcgtcgactgccccccaactcttctggtttcctctacgatgagcggaaggtttgaatcctggaggtggggtctccggtgtggagttctggaaactgtgaggtgatttgcagctggtggaatggaacagtgaagaagcattggaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaaacccagcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccgttacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcatttccttatctgttaatcctgcttatgtgagtgtgaggaaagtctttgagagggcatgaaagtgccaccttatatatgtctgtgactttaaagagctatatgcagggcctggtcccacttttgtccatggatttcagggggaaaaaatatatgtacttttttcagcttccaagcattgaa

SEQ ID NO: 141297 - DNA, 811 bp, Homo sapiens
  Payload ID: 7771
  Gene Symbol: HMBOX1
  Gene Name: homeobox containing 1
  ENST ID: ENST00000519662
  CDS Start-End: 458-811
gttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagagtttcgctcttgtccatgctggagtgcaatggtgtaatctcagctcaccacaacctccgcctcctgggttcaagtgattctcctgcctcagcttcctgagtagctgggattacagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatggg

SEQ ID NO: 141298 - DNA, 817 bp, Homo sapiens
  Payload ID: 7771
  Gene Symbol: HMBOX1
  Gene Name: homeobox containing 1
  ENST ID: ENST00000522468
  CDS Start-End: 1-138
gatgacagtacgagccatagtgaccaccaagaccccatctcattagctgtggaaatggcagcagtcaaccacactatcttggcattggcccgacaaggagccaacgaaatcaagacagaggccctggatgatgactgatcagggagctgcagtatctctcttcctgaggtccagaggccattaaagaataaacatggggcttagaggtgtcttggccaccaaacacaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaat

SEQ ID NO: 141299 - DNA, 1551 bp, Homo sapiens
  Payload ID: 7771
  Gene Symbol: HMBOX1
  Gene Name: homeobox containing 1
  ENST ID: ENST00000519047
  CDS Start-End: 112-1272
ggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgatta

SEQ ID NO: 141300 - DNA, 1731 bp, Homo sapiens
  Payload ID: 7771
  Gene Symbol: HMBOX1
  Gene Name: homeobox containing 1
  Uniprot ID: Q6NT76
  ENST ID: ENST00000524238
  CDS Start-End: 6-1337
aaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttcccc

SEQ ID NO: 141301 - DNA, 2216 bp, Homo sapiens
  Payload ID: 7771
  Gene Symbol: HMBOX1
  Gene Name: homeobox containing 1
  Uniprot ID: Q6NT76
  ENST ID: ENST00000521516
  CDS Start-End: 112-1026
ggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaaggaacacttggtcccctgagagaaggatggaagaaaataaatggaagttgctttctgcagggtaggagattggctggacagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaaaaaaaaa

SEQ ID NO: 141302 - DNA, 1730 bp, Homo sapiens
  Payload ID: 7771
  Gene Symbol: HMBOX1
  Gene Name: homeobox containing 1
  ENST ID: ENST00000523613
  CDS Start-End: 333-1523
aatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggtgagcccctgcgcagctgggcgaggttcttggtgcctgagcagggggtatagtgggacagcttagttccttgggtgtggctgatggggtgggggaggggaaacagtcactgtccctccactctgctcctgtgtctagttagatttcatgtaatttgaaaggaatgtggtaagattcagttgtcctgttgaatttgtgagagatcgttattcacccacatggatttattgtcatacaacaggatacttggcaagtacgcaatggggaggagga

SEQ ID NO: 141303 - DNA, 1426 bp, Homo sapiens
  Payload ID: 7771
  Gene Symbol: HMBOX1
  Gene Name: homeobox containing 1
  ENST ID: ENST00000560599
  CDS Start-End: 333-1426
aatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccagaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagc

SEQ ID NO: 141304 - DNA, 1765 bp, Homo sapiens
  Payload ID: 7771
  Gene Symbol: HMBOX1
  Gene Name: homeobox containing 1
  Uniprot ID: Q6NT76
  ENST ID: ENST00000558662
  CDS Start-End: 342-1559
gttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggtagaagaagagaggaggatctgatccaaacaagcaagttacaccattcacgacacacactcagtgtttgagaaatactaggggcagctggaccccatgcctaaacacgtaccgacgcagggcacgatggaaggccccactcactctggccccactgcagtgggaaccctcctgcccaaaggagtggttcttccagagtctctggcacactgacacatgcatcctctcat

SEQ ID NO: 141305 - DNA, 1694 bp, Homo sapiens
  Payload ID: 7771
  Gene Symbol: HMBOX1
  Gene Name: homeobox containing 1
  ENST ID: ENST00000355231
  CDS Start-End: 227-1387
gagaactgtagagatggtgtgatgtggagatggattttttgcatcctcaagtcggtagataggtgggaaaggaaaagtgtttcttaatattttattccggaaccgtgttttggttacactattggggctactttgaaaggcgtcctccacccaccttcaccccgaaacaaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgcagcaatcctggagagtcatgggatagatgtgcagagtccaggaggccactcaaacagtgatgatgtcgacgggaatgactactctgagcagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcatt

SEQ ID NO: 141306 - DNA, 1975 bp, Homo sapiens
  Payload ID: 7772
  Gene Symbol: HOXD1
  Gene Name: homeobox D1
  Uniprot ID: Q9GZZ0
  ENST ID: ENST00000331462
  CDS Start-End: 224-1210
gccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 141307 - DNA, 1989 bp, Homo sapiens
  Payload ID: 7773
  Gene Symbol: HOXD10
  Gene Name: homeobox D10
  Uniprot ID: P28358
  ENST ID: ENST00000249501
  CDS Start-End: 256-1278
ctgggccggttgtctccagcgcgcactatcgcgggcgcgtagtagatgtcgctgttgtccgtgcttacccggccggccggccaggctctggagcacgtgacccgagaggaggctgcggctcaaggccattttcaaatctcattggcttggttgtcatgtggtcggcagaggcatccacaattacacggggaatgttttcctagagatgtcagcctacaaaggacacaatctctcttcttcaaattcttccccaaaatgtcctttcccaacagctctcctgctgctaatacttttttagtagattccttgatcagtgcctgcaggagtgacagtttttattccagcagcgccagcatgtacatgccaccacctagcgcagacatggggacctatggaatgcaaacctgtggactgctcccgtctctggccaaaagagaagtgaaccaccaaaatatgggtatgaatgtgcatccttatatacctcaagtagacagttggacagatccgaacagatcttgtcgaatagagcaacctgttacacagcaagtccccacttgctccttcaccaccaacattaaggaagaatccaattgctgcatgtattctgataagcgcaacaaactcatttcggccgaggtcccttcgtaccagaggctggtccctgagtcttgtcccgttgagaaccctgaggttcccgtccctggatattttagactgagtcagacctacgccaccgggaaaacccaagagtacaataatagccccgaaggcagctccactgtcatgctccagctcaaccctcgtggcgcggccaagccgcagctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttca

SEQ ID NO: 141308 - DNA, 1533 bp, Homo sapiens
  Payload ID: 7774
  Gene Symbol: HOXD11
  Gene Name: homeobox D11
  Uniprot ID: P31277
  ENST ID: ENST00000249504
  CDS Start-End: 71-1087
tgcaatcgatggctcaggttggctgcgcggggagcggccagaggctcgctggcgcgcacgccgcggagtcatgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggctccgcacgtccagcccgtgcgcgaagtggccttccgcgactacggcctggagcgcgccaagtggccgtaccgcggcggcggcggcggcggcagcgcggggggcggcagcagcgggggcggccccggcgggggcggcggcggcgcggggggctacgctccctactacgcggcggcggcggcggcggctgcggcggccgcggcggccgaggaggcggccatgcaacgcgagcttctcccgcccgcgggccgccggccggacgtgctcttcaaggcgcctgagccggtgtgcgctgcgccggggccgccgcacggccccgcgggcgccgcctccaacttctacagcgcggtgggccgcaatggcatcttgccacagggcttcgaccagttctacgaggcagcgcccgggcccccgttcgccgggccgcagcccccgccgccacccgcgccgccacagcccgagggcgcagccgacaagggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctcttctctgtggaacttcacgattccttcccacggtcaactcgggacctcccagcgaccactgcagcctgcggacgaggccgggacttggccgagcggatcctaataaggggaaaatggtaaatgcaaacgtcccgttacaattttaccgccagtgtgctgtcgttccccctccccctctccgagtcctcgtggggacacggcggggtctgtaggaagttgggccgggttgggggttgctagaaggcgctggtgttttgctctgagttttaagagatcccttccttcctcttcggtgaatgcaggttatttaaactttgggaaatgtacttttagtctgtcatatcaa

SEQ ID NO: 141309 - DNA, 626 bp, Homo sapiens
  Payload ID: 7774
  Gene Symbol: HOXD11
  Gene Name: homeobox D11
  ENST ID: ENST00000619244
  CDS Start-End: 40-525
atgaacgactttgacgagtgcggccagagcgcagccagcatgtacctgccgggctgcgcctactatgtggccccgtctgacttcgctagcaagccttcgttcctttcccaaccgtcgtcctgccagatgactttcccctactcttccaacctggaccggggcggcggcgggggcagtccctgcaccaaggcgacccctggctcggagcccaagggggcagcagaaggcagcggtggcgacggcgagggccccccgggagaggcgggggccgagaagagcagcagcgcagttgccccccagcggtcccggaaaaagcgctgtccctataccaagtaccagatccgcgaactggaacgcgagtttttctttaacgtgtacataaacaaagagaaaagacttcaactctctcggatgctcaacctcactgaccggcaagtcaaaatctggttccagaatcgcaggatgaaagaaaagaaactgaacagagaccgtctgcagtatttcactggaaaccccttattttgagagctccaggaagcgccctcaccccagccccactcacccaccctccttcccaccagcctgctctccgcaggcccactgtccttgggtttaatgacgtctct

SEQ ID NO: 141310 - DNA, 841 bp, Homo sapiens
  Payload ID: 7775
  Gene Symbol: HOXD12
  Gene Name: homeobox D12
  ENST ID: ENST00000404162
  CDS Start-End: 1-741
atgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactag

SEQ ID NO: 141311 - DNA, 1318 bp, Homo sapiens
  Payload ID: 7775
  Gene Symbol: HOXD12
  Gene Name: homeobox D12
  Uniprot ID: P35452
  ENST ID: ENST00000406506
  CDS Start-End: 73-885
tctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatgg

SEQ ID NO: 141312 - DNA, 2240 bp, Homo sapiens
  Payload ID: 7776
  Gene Symbol: HOXD13
  Gene Name: homeobox D13
  Uniprot ID: P35453
  ENST ID: ENST00000392539
  CDS Start-End: 1-1032
atgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaaggcctttggaaagacttgaatatgtatttaattccccccaccccctgccaatggtggcaaattttgtgaattgtttttctctcttccccttatctggctctaaaaccttctgctgcccaacctgactttgtagttctgatttttacttgtttattattggttttgttcttgcctagggtttttaaaatatctgtttttaatgttttgtttctccctccaggccagtataaagggacttgaagtattttttaataatccgccccccaatgaacttcagaagtgccattctgatttaagggtttttttaaaaaattactttatttgttcattcccagcactgattatcttcataatccattaggacagaatggttttcagtcgttcatatcctgtaattaggtaattgaatcattagctctcagcagttgccctgaggcaagtggaaaggcaggcagtgctctggggtcaccgagaaagtctaaaaacaggaggctgaaggtactgtgatggctttaaaaatggccaccttattaaatagggattgtatcaatattgaaatgaagacaatctttccaactttgggtgtttcacttgctgttttaattgtttgtttttaacactttgtaggtttgtgttttcataatctttaatttgaaactcatgtgtcctcatggatcgtggatgccttcatttcttgagctctcaatgcagacatttaaatggctgcaatcagtagagtgacccgcggatggcataaatgcacctccttttcttggccttggatctatgggtctgggattgtggtcatctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttc

SEQ ID NO: 141313 - DNA, 2303 bp, Homo sapiens
  Payload ID: 7777
  Gene Symbol: HOXD3
  Gene Name: homeobox D3
  Uniprot ID: P31249
  ENST ID: ENST00000249440
  CDS Start-End: 177-1475
gcctccacagatatcaaaagaaacctgaagagcctacaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcggaa

SEQ ID NO: 141314 - DNA, 2384 bp, Homo sapiens
  Payload ID: 7777
  Gene Symbol: HOXD3
  Gene Name: homeobox D3
  Uniprot ID: P31249
  ENST ID: ENST00000410016
  CDS Start-End: 275-1573
agttgaacctcagcctggttccgttctaccgggaattccgtgtgctcgagtatatggccgtgtctgcgagcgcgcaagaccagggttgggacagtgttgtctgcagacaaagggggaaggctagctctgccccccactggcgcccactctgaggccgaggacaccaggtttatgataaattgggatccaggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaa

SEQ ID NO: 141315 - DNA, 428 bp, Homo sapiens
  Payload ID: 7777
  Gene Symbol: HOXD3
  Gene Name: homeobox D3
  ENST ID: ENST00000432796
  CDS Start-End: 128-428
agacgcccggaccgaccgccgcctgtagctcggcagccttcgggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtg

SEQ ID NO: 141316 - DNA, 1464 bp, Homo sapiens
  Payload ID: 7778
  Gene Symbol: HOXD4
  Gene Name: homeobox D4
  Uniprot ID: P09016
  ENST ID: ENST00000306324
  CDS Start-End: 413-1180
ataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatca

SEQ ID NO: 141317 - DNA, 1917 bp, Homo sapiens
  Payload ID: 7779
  Gene Symbol: HOXD8
  Gene Name: homeobox D8
  Uniprot ID: P13378
  ENST ID: ENST00000313173
  CDS Start-End: 628-1500
tccgtgcagtgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaaccgaggccagagtgtccccgtgggccgagcgcacttttttcttgtccgggtgcgctcagtcactggtgcctgagaggaaacagtggaggcagcggggcaggtcgcctggggcgtcggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccagtagctgagcgcccgcggctgcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaa

SEQ ID NO: 141318 - DNA, 1608 bp, Homo sapiens
  Payload ID: 7779
  Gene Symbol: HOXD8
  Gene Name: homeobox D8
  ENST ID: ENST00000429017
  CDS Start-End: 205-525
cgcgcggatccctccgcggggctcctcgtccccgtcacgctgactttccgtgcagtgctgtggtgcgaaaatgcctcgccgagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctgga

SEQ ID NO: 141319 - DNA, 1268 bp, Homo sapiens
  Payload ID: 7779
  Gene Symbol: HOXD8
  Gene Name: homeobox D8
  Uniprot ID: P13378
  ENST ID: ENST00000450510
  CDS Start-End: 11-880
tgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaa

SEQ ID NO: 141320 - DNA, 1235 bp, Homo sapiens
  Payload ID: 7779
  Gene Symbol: HOXD8
  Gene Name: homeobox D8
  ENST ID: ENST00000544999
  CDS Start-End: 187-747
cggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccacgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttccttta

SEQ ID NO: 141321 - DNA, 1870 bp, Homo sapiens
  Payload ID: 7780
  Gene Symbol: HOXD9
  Gene Name: homeobox D9
  Uniprot ID: P28356
  ENST ID: ENST00000249499
  CDS Start-End: 50-1108
gtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaa

SEQ ID NO: 141322 - DNA, 1131 bp, Homo sapiens
  Payload ID: 7780
  Gene Symbol: HOXD9
  Gene Name: homeobox D9
  ENST ID: ENST00000613849
  CDS Start-End: 37-1062
agtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcaggcgacggggggaacgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaaacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtggg

SEQ ID NO: 141323 - DNA, 6997 bp, Homo sapiens
  Payload ID: 7781
  Gene Symbol: HIPK1
  Gene Name: homeodomain interacting protein kinase 1
  Uniprot ID: Q86Z02
  ENST ID: ENST00000340480
  CDS Start-End: 195-2705
atagtaggcaatatttatgtgtcatttattattattgctattagtgttacctattattttctttttgaacccacttattgcctaattagtcatagtttgacaattgcccttgtattccaccatgtcaaatataaatttacatagatgaagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgactta

SEQ ID NO: 141324 - DNA, 5766 bp, Homo sapiens
  Payload ID: 7781
  Gene Symbol: HIPK1
  Gene Name: homeodomain interacting protein kinase 1
  ENST ID: ENST00000361587
  CDS Start-End: 1-1474
cacaccgcagtatgcggtgccctttactctgagctgcgcagccggccggccggcgctggttgaacagactgccgctgtactggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgactta

SEQ ID NO: 141325 - DNA, 2883 bp, Homo sapiens
  Payload ID: 7781
  Gene Symbol: HIPK1
  Gene Name: homeodomain interacting protein kinase 1
  Uniprot ID: Q86Z02
  ENST ID: ENST00000369553
  CDS Start-End: 64-2514
agattgtttcacatcaccagtgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaa

SEQ ID NO: 141326 - DNA, 3966 bp, Homo sapiens
  Payload ID: 7781
  Gene Symbol: HIPK1
  Gene Name: homeodomain interacting protein kinase 1
  ENST ID: ENST00000369555
  CDS Start-End: 84-3581
ctgcggggccccagatctcgtctcctccgccgcctcctcacggcagccccagctcgcggctgagaaccagacacaccggcggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctcttta

SEQ ID NO: 141327 - DNA, 8157 bp, Homo sapiens
  Payload ID: 7781
  Gene Symbol: HIPK1
  Gene Name: homeodomain interacting protein kinase 1
  Uniprot ID: Q86Z02
  ENST ID: ENST00000369558
  CDS Start-End: 233-3865
gaggcggcggcggcggcggcgggaaggggctgggtggtggagcgggagggaggctgaggaggctccccctgcgggacgggcgcggggacggctccggggggcgggggccggggcccgggccggctcgcgcggggggtatgatgacccggctgcggggccccagatctcgtctcctccgccgcctcctcacggcagccccagctcgcggctgagaaccagacacaccggcggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgactta

SEQ ID NO: 141328 - DNA, 3424 bp, Homo sapiens
  Payload ID: 7781
  Gene Symbol: HIPK1
  Gene Name: homeodomain interacting protein kinase 1
  Uniprot ID: Q86Z02
  ENST ID: ENST00000369559
  CDS Start-End: 162-3389
gcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaacaa

SEQ ID NO: 141329 - DNA, 3777 bp, Homo sapiens
  Payload ID: 7781
  Gene Symbol: HIPK1
  Gene Name: homeodomain interacting protein kinase 1
  ENST ID: ENST00000369561
  CDS Start-End: 188-3718
gagggaggctgaggaggctccccctgcgggacgggcgcggggacggctccggggggcgggggccggggcccgggccggctcgcgcggggggtatgatgacccggctgcggggccccagatctcgtctcctccgccgcctcctcacggcagccccagctcgcggctgagaaccagacacaccggcggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaat

SEQ ID NO: 141330 - DNA, 4112 bp, Homo sapiens
  Payload ID: 7781
  Gene Symbol: HIPK1
  Gene Name: homeodomain interacting protein kinase 1
  Uniprot ID: Q86Z02
  ENST ID: ENST00000426820
  CDS Start-End: 344-3976
aaacattaaagcctaacctgaggtaatccctcaccggcagtgaagctcctctgctaggcactgtcgtcccgtacactgcccaagctctgggggtgtcacactaaactgtggtgatgtcacactagctgggatgacattttacagttggatcccgtaccaccgccaggcacctttaaatcaccgcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaa

SEQ ID NO: 141331 - DNA, 574 bp, Homo sapiens
  Payload ID: 7781
  Gene Symbol: HIPK1
  Gene Name: homeodomain interacting protein kinase 1
  ENST ID: ENST00000514621
  CDS Start-End: 218-574
atctgtacaagggagatctagaggtctggcccaaagggaaacttttgctgccaccactttcaaagctttcgttaaaaaaacaaaagggagggggaaggtggagaaacaaccaaaattctgtcattccaaataaatctaagtgaactattgattttgatacaaagcaacagcctctgccacactgaagaagtgagctttaagcagagactagaagggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaa

SEQ ID NO: 141332 - DNA, 570 bp, Homo sapiens
  Payload ID: 7781
  Gene Symbol: HIPK1
  Gene Name: homeodomain interacting protein kinase 1
  ENST ID: ENST00000503968
  CDS Start-End: 252-570
gtttgttgtggtgacgagctgtgagcaatggcctgtgtttatgctgggcgagctttctttcctacttggggaggggggttcaggatgggaggatgcgggtagggaagagggggggaaaacccccaagctccacaacattttaagttttttgaagtcattccaaataaatctaagtgaactattgattttgatacaaagcaacagcctctgccacactgaagaagtgagctttaagcagagactagaagggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctga

SEQ ID NO: 141333 - DNA, 8016 bp, Homo sapiens
  Payload ID: 7781
  Gene Symbol: HIPK1
  Gene Name: homeodomain interacting protein kinase 1
  ENST ID: ENST00000626993
  CDS Start-End: 162-3659
gcagagtctgcagtgcggagggggcgggaagtccaggccccgcactcgatccacgctggctccctacggaggcccacctactcgaggcccaccgactcctactgcaatcagtactatgcgatcgtcctagagagtccattcagctgcacttccgcctcagtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctacttacagtcacgttactacagagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcagctgctactctttctctggctaattcagatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacaagcaacaacaaagcattctggattccctgtgaggatggataatgctgtaccgattgtaccccaggcaccagctgctcagccactacagattcagtcaggagttctcacgcagcaggcgtggcctggagggactcagcaaattctcctgccttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtcctctctagatgttctgccttcccaagtctattctctggttgggagcagtcccctccgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgtcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgaaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatttctgtcactagtgtcatacagttttctggtcaacatgtgtgatctttgtgtctcctttttgccaagcacattctgattttcttgttggaacacaggtctagtttctaaaggacaaattttttgttccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcacttgcctagcagtgtgtggctttaaaaactagagatttttcagtcttagtctgcaaactggcatttccgattttccagcataaaaatccacctgtgtctgctgaatgtgtatgtatgtgctcactgtggctttagattctgtccctggggttagccctgttggccctgacaggaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgactgcccttagccaggcaagcacagtaatgtgtgttttgttcagcattattatgcaaaaattcactagttgagatggtttgttttaggataggaaatgaaattgcctctcagtgacaggagtggcccgagcctgcttcctattttgattttttttttttttaactgatagatggtgcagcatgtctacatggttgtttgttgctaaactttatataatgtgtggtttcaattcagcttgaaaaataatctcactacatgtagcagtacattatatgtacattatatgtaatgttagtatttctgctttgaatccttgatattgcaatggaattcctactttattaaatgtatttgatatgctagttattgtgtgcgatttaaactttttttgctttctccctttttttggttgtgcgctttcttttacaacaagcctctagaaacagatagtttctgagaattactgagctatgtttgtaatgcagatgtacttagggagtatgtaaaataatcattttaacaaaagaaatagatatttaaaatttaatactaactatgggaaaagggtccattgtgtaaaacatagtttatctttggattcaatgtttgtctttggttttacaaagtagcttgtattttcagtattttctacataatatggtaaaatgtagagcaattgcaatgcatcaataaaatgggtaaattttctgacttatgtggctgtttttgacttctgttataggatataaaggggatcaataaatgacatctttgaaagtg

SEQ ID NO: 141334 - DNA, 2937 bp, Homo sapiens
  Payload ID: 7782
  Gene Symbol: HIPK2
  Gene Name: homeodomain interacting protein kinase 2
  ENST ID: ENST00000342645
  CDS Start-End: 1-2736
atggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcacactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccaggtaatttggggccaggacagggcaggaacctctccctggagagtggttttcctgcttttctgctgctagaaatgttgctgtatgggagctagtacaatagaaagtgcccagtgactgcaggcgacccttaccgaggattttattcaagtatccaggggaggcttctgctgaacagcacattgtataagcagcgttttccttctttaatcctgtaatcaatacctctctgcctttacaatggctctgcttccaactaggttgattaatagaaaataaaagcctcctggttcttt

SEQ ID NO: 141335 - DNA, 15049 bp, Homo sapiens
  Payload ID: 7782
  Gene Symbol: HIPK2
  Gene Name: homeodomain interacting protein kinase 2
  Uniprot ID: Q9H2X6
  ENST ID: ENST00000406875
  CDS Start-End: 96-3692
ctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcgggggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaagaaaaaggaaaaaaaaaaagtcaataacaaaaaacccagctcaagaacccattctacgccaaactggaaaggagaagagagcaacaggaagattccagaaacggggggccccagtttttgaagaactttatgaacttttcaaagattattttcatatggcagcaagtgatacggaagactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggccaggctgctggaaggcccccgggggcgcggggcgagttttctttttctgagcactctggataaatccctaagcaacgttgtttctcaaatgtcattaataatgtgtgttgcaaactttaggtttttttcttttctgaaaatgtattttctctttgaatccacccctagtcgcgtagcgtagggctagcggtcgtcacagacaccctagtagaatgtagcactcagcacccttgtctcctaccttgtgttcaactccaatgataccaatagaatattcctcaatgtaattgcacaaaaaaaagcgatataacataggcatgtaaccaatgtggcggtgcaggtgtgcgggtgagcgagcacgtgtgggtgtgcacgcgccgccctccccgcgtggccctcggcgccgccaccctagctggcgcagtcttgacactgcatccttccctcctagtgccttaccgagcgacagacgcggcgtgagggtttacttccactggtactccaagaaactgaggctagtcagacacaatctcagctcttctgttgtgctgttgtaacagtttacgctggccttttttttttctttttctttttctttttaaaatgttaatgcccgttgtctttcctgggctgtttgctagcggaaggatgccagggaagccagcaggagctaggagagagtccgtggatctcgaaagaaatatgggagacagatgcccggcgggtgcgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggagggacacttatgagggtggccgggggtctgacgctgcactttggaaaaactcacacagttgaatttccaaagaaatctgccctttgccctctttgcacctttgatacattctggaagttttctcaggctttggacacttctggggatggaggtgtggagaagtggggagttccctctcttcatagtaaataactctgaaatatgtgaatgtgaatggcaggagaatctggccaaggatggggccgaaaagggtggttctaattgtttgcttctgatgttgagtctttagctgaccccacaggcaggtttccaaggtgcaaagagatctttcccgagtcagcggccccatcctcatcctccctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaaaaagaagggttggagcaaagcggcattcatctcctggactgttagcctttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcatgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagattttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 141336 - DNA, 3969 bp, Homo sapiens
  Payload ID: 7782
  Gene Symbol: HIPK2
  Gene Name: homeodomain interacting protein kinase 2
  Uniprot ID: Q9H2X6
  ENST ID: ENST00000428878
  CDS Start-End: 156-3671
cacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcgggggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaa

SEQ ID NO: 141337 - DNA, 7408 bp, Homo sapiens
  Payload ID: 7783
  Gene Symbol: HIPK3
  Gene Name: homeodomain interacting protein kinase 3
  Uniprot ID: Q9H422
  ENST ID: ENST00000303296
  CDS Start-End: 306-3953
cctcgccctagccaagccgtccccaccccaaatccccgggaaggaagatgagggagacgggcccggcgcttagcagccagagcagcagcagcagcagcagcggtcgggggagggtgtttcgccgtttcctctcagccgccaggacaagatggcagcggccgcggagaggggctgagcccgggctgggtggtgccgcctgctgaagcgcctggctcccggtccccggcacggccctgcgccccaccccggacatgctcagggctgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacagaggtattttggtaaaactaatggaatgggagccaggaagagaggaaataaatgctttcagttggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccaatgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagcaaa

SEQ ID NO: 141338 - DNA, 7345 bp, Homo sapiens
  Payload ID: 7783
  Gene Symbol: HIPK3
  Gene Name: homeodomain interacting protein kinase 3
  Uniprot ID: Q9H422
  ENST ID: ENST00000379016
  CDS Start-End: 306-3890
cctcgccctagccaagccgtccccaccccaaatccccgggaaggaagatgagggagacgggcccggcgcttagcagccagagcagcagcagcagcagcagcggtcgggggagggtgtttcgccgtttcctctcagccgccaggacaagatggcagcggccgcggagaggggctgagcccgggctgggtggtgccgcctgctgaagcgcctggctcccggtccccggcacggccctgcgccccaccccggacatgctcagggctgcggccgcccgaagaggagagagcgcgggcctctaggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccaatgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagcaaa

SEQ ID NO: 141339 - DNA, 7399 bp, Homo sapiens
  Payload ID: 7783
  Gene Symbol: HIPK3
  Gene Name: homeodomain interacting protein kinase 3
  Uniprot ID: Q9H422
  ENST ID: ENST00000456517
  CDS Start-End: 363-3947
ttcattaaggggaacaaacaaacgcgcaggcacgcagcttgagcaccccagccgatggccgcgtcccgggctttgtggccccgtccccagcgtcgcggagcagcgggtttgcagggtgtcaactctggggacgtgcgtgcgtgtgtgtgattgttggggaggagaaatgtgatccgcggctccgcgtccccagcggcggcgggaggaaggcgtggcggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtgaaaaacagtatattggggaagctcaatgatacaaacatttgattaaaaataaaaacatggtatttaatattagccatggcacaagaaaattatttttgaatcatgtagacttgggtgcaatttaaacaactttgagctttaaaaactcacttttgatgtgttttgcacatttggtataacttgtctttggtcatgttatcttcttatgtagtaactctagacaggtgacttatgggagcagaagtccagttttgctcctgctattttttataaattgccttctaactagtgcaagacacgtctacatttgggaagccattctgtgtacagacttagagcaacagatgcacatatgtcagaattacagcatacaagtgaattgtattatccgtgtcttagtgtataaatgttgggtcacttacctaagaaattgagctattgttctttacatttgcatgtgtcttttgcatgggcaaaatgttgcctagactttgctcttaaatgttgttctaataatctcagctgcattgtaaaccgttcctacacatagtgccttaaatatttgaggttgttaatgttattacctatatataaatgttgaggactgcagcacttaaaattcagacctactatttagtttccttttgatagcgtaatgttcatttttgtttttgtgtggtatgatttcaggtagtagctgtttttttccttattaagagggcagcatgtttgctatagctgaattctgctgtctgatttttcagaatgatctagcttcaagaaaagcaagcagttagtagtgcttaagaaaaattgattcagtatctaatggatagttgataactgtcacagcacagcattttatatactgttaagtgaaactgcaatacaatctaagtttattttgagagtgtttgctgtataattggacttaataaaatgtttagaggtacagtaggcatgactttgggtagataataaaatgcaaaatgctcattgattcatgatgtggttttatcttagcttgggcaaaccatgcagtatttaataaatagtagcagaacttttactattgaagcttgaaaagatgtgagttctttgtgtgcaatttttgatttatgcatgtgagagggttttttttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccaatgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagc

SEQ ID NO: 141340 - DNA, 3668 bp, Homo sapiens
  Payload ID: 7783
  Gene Symbol: HIPK3
  Gene Name: homeodomain interacting protein kinase 3
  Uniprot ID: Q9H422
  ENST ID: ENST00000525975
  CDS Start-End: 84-3668
gatttcctaatctccaggaggaaagaaactagtctttgggagttaaaccgactaatttaacggagaattaccaatgtggaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggcgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacaggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtga

SEQ ID NO: 141341 - DNA, 591 bp, Homo sapiens
  Payload ID: 7783
  Gene Symbol: HIPK3
  Gene Name: homeodomain interacting protein kinase 3
  ENST ID: ENST00000531504
  CDS Start-End: 363-591
ttcattaaggggaacaaacaaacgcgcaggcacgcagcttgagcaccccagccgatggccgcgtcccgggctttgtggccccgtccccagcgtcgcggagcagcgggtttgcagggtgtcaactctggggacgtgcgtgcgtgtgtgtgattgttggggaggagaaatgtgatccgcggctccgcgtccccagcggcggcgggaggaaggcgtggcggccgcgcggcggggctgttgccggcttctctcgttacggtggctgccgcccgcttcccttcgccgcactgggagaactggcggaaagactttggatgaaaatgtctgtttctctgtcgggagggagacggctgttgtaaaatggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaactttt

SEQ ID NO: 141342 - DNA, 2452 bp, Homo sapiens
  Payload ID: 7784
  Gene Symbol: HIPK4
  Gene Name: homeodomain interacting protein kinase 4
  Uniprot ID: Q8NE63
  ENST ID: ENST00000291823
  CDS Start-End: 286-2136
agagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcaacccccaccctgacgctgccaacccctggcagctcaagtcctcggctgactacctggccgagacgaaggtgcgcccattggagcgccgcaagtatatgctcaagtcgttggaccagattgagacagtgaatggtggcagtgtggccagtcggctaaccttccctgaccgggaggcgctggcggagcacgccgacctcaagagcatggtggagctgatcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcaagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgagacctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagca

SEQ ID NO: 141343 - DNA, 774 bp, Homo sapiens
  Payload ID: 7785
  Gene Symbol: HOMER1
  Gene Name: homer scaffolding protein 1
  Uniprot ID: Q86YM7
  ENST ID: ENST00000282260
  CDS Start-End: 21-695
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaagtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 141344 - DNA, 5881 bp, Homo sapiens
  Payload ID: 7785
  Gene Symbol: HOMER1
  Gene Name: homer scaffolding protein 1
  Uniprot ID: Q86YM7
  ENST ID: ENST00000334082
  CDS Start-End: 1444-2508
gcctcccgtcccttcccgcgagcagagggagggaccgccctcgctccccgttctctccgcccccttcccgccccccgcagcccactctgccgccgcgctagcttcacgccggcggcgctgaccgggaaagcagcaccctcttctctgccagccggccggccggcggaggcggaggcagcggcaggcttcaggccgccggggctggcgctgctctgcccggcggtagccggaggcgggcgctgatggaagtgtgaagaggcggcggcggggcccggggaatgtgaggcggcgcgtggcggcggcgcggagcgtgagagacgaggagtaggggtgggggcgctggagcggcggctgcgcttcggcttcgagcccagctctcctggccccaacgcgggcttagcctcccgccttggctcgggcaggcgcccgtcgacccttcggcccctttcgcccgccctggagctgggggcagggtgccagtggaagcgtggggcttggctctgtgattcattcattctccgccgacgggagcctcagacccgctgtgctctgaagagaggagggaagagggggcagccgcgaatgaagggccgggcaccagccgggctccattgtgctcggcggcggggggcgggaaggggctgagggaggtgggatcgggtcccctcctccagctctccggcgtgcgctgcgcccccagcctgctgccagcctggaaatggctccgtttattctcttcgggagaatgaatcgatcctgcctagccttctcttcgtcctccccacctcttctctgctccgagtcttaggaggagaaacatttaaaaagacagattccaatgtggagtgccgtgcaggttgcgagctgccgggtttgcacttcgaggagattttcctgtgtagtttttttcctaatgtgagcgcagggaagccgtggcattactgcttttgggatttttattcacgtgcacgtcgcgtttggttgctcgctccacccccggagacctggtgtggtggagaaatttgaacccgcagccttagctccgaaaaggccgagttacctggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacatagttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtctaggtcacatcccctttttgtgttcaacacagtgaagattatctgctttttaaattaatttatttacgatatctagagctgtgttttgtgcaaaaacttagtgatgaaagcctgtcttttgttgtaatctgaataatttctcaggatatttttgcactgctgagaagcagtgccattaccaattaattcttgccaggagtgagagagagctgtatctttaattgaaatatactataactgggtgtatagagttcttcccttttttgtgctggaagatatttcactctggtgactactctggtacactctggtgttctctaatcttgtctgttgtatagtttacttttccatattgattccatgtatttatgagaagatattgtctcccattttattacacattttaaagccaactaacgaaggcagctgagtccctcagaaatttttctttttaagtttctaataaatttgacacacagtactgaaatacagcagcccgtcattgacaggctggtctagcaatgttaagtatatttacagaatatgcagttacatttatttatatattttgcaagaaatcttttctgaatgatcaatgcatttcaatttacgaataataatggttattggggaactgtttattatagataattttaaggtgtatagctattttaaagggggtccatttacatcaaacagctgatcagaggactctatctaaattgtgatcgtggcagatagagatggagtcatgtactctatctggctctacacatcaatcacatcttgattcaaacctcacaaggcaatattctgaattgttaactaggtatttcaaaacaggaattaaattcaataggctcttctcagtgaacaggttttaatgttgttttgatgtaattttaaaagacttttagcaaacatgcatttctttatatgatatatttcttttacgaagctattttaaaagtaagccaagtgctgtctagtctgcttataaagtaggaattgcatcagagtacatatattcttgctgtacaatgcctgtgatgttgaggagggttcttttttaaagtgtatgcttgagtaactgactctatggagtctataaatgcactgacttcttgtttgtaccccaaaatgatcgaattgttaagtacaaaattaagctaattaaccaatttgtaaccattttttcactcataaacagctactcaatactagacaattttgttttttatgtatgtgtatgtacgtaaatacatacatattaatttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactagggatcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtcattgaactgttgggaagcagttagaggaaaagctcactttttttttcaggtggaaataaaaggaacactcaaaattaagccaacaccaccactacctttaaaaactagtttatttgccctgttaaaattaaatgtattctttaacatgtgggctacagtctcccatgtttttatttaactgaagcatatacacttcggtcatttatctccttgtggtcctgattttgtcagtactggaatgggaggcaggtcggggaaagtttgtttgatggcagtggattcttattgttgttttaaccattgcattt

SEQ ID NO: 141345 - DNA, 815 bp, Homo sapiens
  Payload ID: 7785
  Gene Symbol: HOMER1
  Gene Name: homer scaffolding protein 1
  Uniprot ID: Q86YM7
  ENST ID: ENST00000508576
  CDS Start-End: 21-554
gcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcagaagtttggccagtgggctgatagccgggcaaacaccgtttatggattgggattctcctctgagcatcatctttcgaaatttgcagaaaagtttcaggaatttaaagaagctgctcgactagcaaaggaaaaatcacaagagaagatggaacttaccagtacaccttcacaggaatccgcaggcggggatcttcagtctcctttaacaccggaaagtatcaacgggacagatgatgaaagaacacctgatgtgacacagaactcagagccaagggctgaaccaactcagaatgcattgccattttcacataggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 141346 - DNA, 642 bp, Homo sapiens
  Payload ID: 7785
  Gene Symbol: HOMER1
  Gene Name: homer scaffolding protein 1
  ENST ID: ENST00000535690
  CDS Start-End: 21-563
gcaagttttcattgggcaaaatgggttcagcaatcagcaaacattgggaggctgaactggctaccctcaaaggaaataatgccaaactcactgcagccctgctggagtccactgccaatgtgaaacaatggaaacagcaacttgctgcctatcaagaggaagcagaacgtctgcacaagcgggtgactgaacttgaatgtgttagtagccaagcaaatgcagtacatactcataagacagaattaaatcagacaatacaagaactggaagagacactgaaactgaaggaagaggaaatagaaaggttaaaacaagaaattgataatgccagagaactacaagaacagagggattctttgactcagaaactacaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaaga

SEQ ID NO: 141347 - DNA, 1990 bp, Homo sapiens
  Payload ID: 7786
  Gene Symbol: HOMER2
  Gene Name: homer scaffolding protein 2
  Uniprot ID: Q9NSB8
  ENST ID: ENST00000304231
  CDS Start-End: 194-1258
gcccgcccgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaa

SEQ ID NO: 141348 - DNA, 1950 bp, Homo sapiens
  Payload ID: 7786
  Gene Symbol: HOMER2
  Gene Name: homer scaffolding protein 2
  Uniprot ID: Q9NSB8
  ENST ID: ENST00000450735
  CDS Start-End: 187-1218
cgcgcctggcggcggtggcggcagtggcagcagtggcagccgcgcagccccgcggaatggagcggcgccggggctgagccgggcgcgcacgggccgccgcatgtgccgcgcggggagcggctgccgagcgggcggagagcgagcgcgagaggccccgtcggagcggccgccggagcagcgccggagatgggagaacagcccatcttcaccacccgagcgcatgtcttccagattgaccccaacaccaagaagaactggatgcctgcgagcaagcaggcggtcaccgtttcctacttctatgatgtcacaaggaacagctatcggatcatcagtgtggacggagccaaggtgatcataaacagcacaatcacaccgaatatgaccttcaccaaaacgtcacagaagtttgggcagtgggccgacagcagagccaacacagtgtttggtttggggttttcctctgagcagcagctgacaaagtttgcagagaaattccaggaggtgaaagaagctgccaagatagccaaagacaagacgcaggagaaaatcgagacctcaagtaatcattcccaagcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaa

SEQ ID NO: 141349 - DNA, 10341 bp, Homo sapiens
  Payload ID: 7786
  Gene Symbol: HOMER2
  Gene Name: homer scaffolding protein 2
  ENST ID: ENST00000558090
  CDS Start-End: 1-13
caccgataactagggctggccgaggcccaggccccgccctggccctggagcaacctggacggtgttcccttgagctggtgtgacgtgccctcgtttattctgacatccagcccagtctcagtactgttgtcataaccttacgccagactcaggcagaatgtaagccattcactcgtgagcatcgcagccgcttgtgctgcctggaagctgcagggccaggactgcattttcagtttgcaattgaggtctcctgattttggtgtttccaagactggctgctataccttgataagctttccttctgcctccatgaaacctggtgtctaaaaaagatcaactaaaacttggaaccctttaaccaagaggacctttaaaaataacctttcattccagtcaagacccagctggatgcattttaaagttgggagtggcgaggaagccttcctagtgccgcccggggaatgtaaaaccaccagagcaacaggttgggacagtatggtcaggccttggagggaaagagaaccagtatccacacaagacctcgaacttgtgtggcccctcagtttcatctctcctgcctgccatcacattagactttaattgggtgagagaacagggcagagactgtcacctgcattttgcagatgggaagtagagacagagaaagtgacacgcccagggtcacccagcggtgaccagcagcgtggactctgcatccaggtctcctggaccttgatgcagtatcttttgagacatgccactctagtccctttggtgacccgtgggtgccaagagaaaataattcttatatcctgataagagcatattacaattatattatttcaatatgtgtccacagcaaaggacagtttacaaaaatgtgaatccgaatgacatttaggaatgtttgttataaatgataagttccactttggaatgattctggttttgcaggaatctttccaagaaagttggttaaaatgatgtctctgcctgtgaggccagttctatggaaaacaaacacaccctgagttctttattgatggctttagtggaggcagagcagtatgttcaaaacaagtgggaggccctgagatcgcaggaatggaaacagagttctggctgggggtggcctgtccactgcccgccccttcctggagatgcactcctttctggctttctggggagggagcagccttgctcagtggtgggagcagcttgaacgggacctgatcaacacccaggaagactgtgcacagagggcagttggtctccagcctgcaggctccatgagcacagccttgatggtggtgggcaggcgcctgcctgctgtggactacatttgatgcaaaacatcaagtaaagggtggagcgtaatacagtgaatatgcctcccagaaacatcatgctctgcctattttaacagggctctttttctttagaaaagtctccttctctatagaaaccagggacaattttggatgagagccaaccacaggacgcgctggggacgttatggtgggacctcacatgtggccaggtgcacctttgggaagaaggcagacgtgatgtgacttagcacaggcactcaaaagaggcagccactggtctttgctaatatccagaagtggattgtttgttccattcatccttctagaagctaaattctttcattgccttgagacatcactagattttgaagcacttgcaaactagaagcttgcaagatcaatgtccatgtatatttttaaagatatgcatgctttaaaaggaccctaatttctgagtacatggcttccccaaagaaacagtatatattctggagatgatgggggttttggcatggagagggactcctgtctagtctagaaaatgttacttacatgcctcttccatgtaccgatctcaagaatatgggttttctagttggctttaaacactacccaggcaggaaggtggctttggtaagaattttgagctggatgaaatgttctagtgaacttacgactgtgtatgtgcgcacgcgtgtgtgtgtgtgtgtgtgtgtgtgtgtgtgtgtgtgtgtgtgaagaaacagcaaaaggggaagtgggagaaacagtaaggaagcgtttttaattaaaaatatgtatacctaagaggagactttattttctatttctggtggtggtgatctatgttctggaatccatttaccagaagtttgtggatcttttgtttgaagtggaattgttcagtgccctactctctttgacggtgcagagccttgcggcaaagtgttctcctgggccctagagacccccagggcacctggcaggagcccgtaaaccacggcagagtcccaagtggtgcatgttttggcgagtgatgggcaggactgatgattcacagctgtgaggctgtgctattgtttttaccctcttgtactgcttttaataggaagtcccgactttacgtcagttgtgagagcagcgtcttatgatgtgacaggcaagaagacattccttgcatcaaatataagagtttaatgagaagagtggagtggataagtgaactctcccaagagtactgttttttgtttccctttttaaatgctttcttggtacataaataatataatactttttttaaagaaattccagatgagtgggaaaaaaaccaatcacctgttattacactatctgattataaccactgttaacatttcagtttttatcttttcagacttttttctatgcatctgtgtgtgttttattactttttccatgaaatataatcatattatacatactgttttataacttttatcccttttaatgctatattgtgaatagatttctatatcagtaaatatgtaattacattatttttaacctctatgtaggttgtaccttggatacttaggttgtttccaatttttttactgttgtagtcaaggacataatgaagttcttctaacatccttgcgaacttttcagaatattgacttagggtaattttctgaagttatcactggctcaaaagtacgcgcctccctatctgcggctcctttccttctgaggcatacaggacttcaccctccatcccccttgtactcattcagggtcctatgactaattctggccaatgaaatgtgagcacaggtgacacatgaagctccagacagacactgaaatgcccatgagcagttccgcagtgtctgccttcccttccctcagcaaatgctgatgtcccagggacagagcctctgtcaagcctggatccctgagtgactacgtggagcagcccccttctcccttcatgttaccctcacctgccaccctgcatggacgggtagcatgaataaaaaaaataaaccttaggtgttaaacactggggtttcagggttaattggttaactgcagcataacatatcctgttgcaacaataaaaaagaatgcacatttttaggacttgtaatatgtattgcctcaaattgccttccagaaagacagacccaattatactcccacccacagtgtgtgagtgtgtactgcttcctctttaacactggagttaccctggggacagagagctaaaaaaaatatttttttggttaaaatgtaaccctttaaggtgttcagcagtatcattgatttctaagaggtttatttcataaacattgtaaaacaaaattttaagttgcacgtatggctttttaaaaacgtttagacatttaaaaaaacaccttttagtcaagtttatctgttacttttttttttttttttaatggttgctacctatgccgtcatgcttatgcaggtctttccaattcttttttttttttttttttttttttttttttgagacggggtccaccctggcccccaggctggagtgcagtggcgtgatctcagctcactgcaacctgcgcctcccgggttcaagcgattctcatgtgtcaacctccctcctgagtagctgggactacaagtgtatgccaccacgcccaggtaactttttgtttttagtagagatgggtttcgccatgttgcctaggctggtctcgaactcctgaactcaggcaatccacacgccttggcctcccaaagtgctggaattacaggtgtgagccaccaagcccggcgaggtcttcccaattctgatggcaaggttgtataaatattcaccactatcttattcttgtacttttattatttctttctaaacagttaaatctgtgatctggctgggcgtgttggctcttgcctgtaatcccaacactttgggtcgccaaggtggaaggatcacttgagtccaggcatttgaggttacagtgagctttgatggcaccggtgcactccagcctggggaacagagcaagaccctgtctctaaaaaaaattttaaaaacctctgatctatctggaatgtattttctaaattaccccaacactgtttattgggaagtctgtcctttattctatatgaaatcccatttttgccatacacctagtagcccttctgttgggtgccaggataagcaccctggccttgagtgtgctgtgaactctttattatgggttgtgatcttcctgcacattctagcactggtaccacattgtttggatcgccatagctttggactaaacttccccattaaactttttcaaaacttgcctagtatattgtgcaggccgggcatggtggctcacgcctgtaatcccagcactttgggaggccaaggtggatggatcacctgagatcaggagttcgagaccagcctggataacatggcgaaaccccatctctactaaaaatacaaaaaaaaaaaaaaaaaaaaaaaattagctggctgtggtgataggaacctgtaatctcagctacttgggaggctgaggcagtgaacccaggaggcagaggttgcagtgagctgagatagcaccagcctgggcaacggagcgagactctgtctcaaaaaaacaaaaaacaaaacaaaaaaaaaaccttccaaaagaagtttgagataattttatgtttagaaaaattagaaattggattgagtaaaatttacatattttacacaagaggactaacatctttataatatttaacctttcagtaaatttatgttttatgtttctcagcctatcttttctagtataggtgatttttttagtgtggttactattgtaaatgagatcctactactttaaaaaatgaaaattaaatctatcgcttttatgactttaaaacattagacttatgtaagtgtaaacattatttaaaaacataatgtagaaaattaaagtcccccataattaaaatccctttcccccagaaaaagtcaacagcatattcatcagttttttcctaaagtatgttttagcactttgaccatatgagacaacccttctgctgttagcatttttctctttgcaatagatcttcctatgtcagtacacatcaatctacctcattcttacctctgcataagagagtagtgtgtagttgtataatagtttaacttggcgattggttattgattttgtaactagccagttactgaattattctaaaggttttgctgttgttaatttctttcgcctttttcagttgggtaatagttctgggtaggttgataattttattcccatatttgtaatcttatttcactttctcaactcatcacattgactggtacttttagaacaatgttaaaaaacatttacataattgtgctgatattgtacattatttgatatatatatatcaaattttttttacttagaagagtgtttctccaaaactataaatttgactcttagtgtaaaataatcttaatatttgaattatacattcaggttatgccctctatttctagtttgatgaaaatattattagtaatggatgttggggttttattaaatggcttttttccacatctgtcaagatgatcaactggcttttctctattatgactttagatgaatcgttttaatagatttgctaatgttaagacatctctgcatttctacaagaatctgatgtagtcatagtatactattcttttaatatacatctcctttcaatgttaacagtggttatttatgattggttggtccatagtagatttttattttgtgtttcttatctgtactttctgatttttctacaaagattgtgtattacttgtataataaaaataagagctttaaattgtgaaattcttctggatttggttttctcattttattatggaatttttcatacctaaataagatgaatagttgggtaattttttttctgctttgtcagttattggtgtttgttaacttcttaaaaaaattaaaaagaacttgggaagctctgtttttctatgccctggaaacatttaaatatttagaattttttgctctttgaagtttttataacatgtatgaaactgtccaaatctagtagtgcctttttaggaaatatggggttgttgtttttttttaatttttttcatgctcattattttcttcaaactttatttctattctgtaagtttttggcaatttaaattttcccggctaagcacagtggctcatgcttgtaatcccagcacttctggaggcggaggcaggaagattgcttgagcccaggagttcacaatcagcctgggcaacatagtcgctactaaaaattagctaggcatggtggtgtgtgcctgtagtcccagctactcaggaggctgaagcagtaggatcacttgagccctgggggccgaagctgcagtgagccgtgagcatgcctgggacacagagcaagaccctttctcaaaaaaaaattttttttaattaagtgaattttcctaaatagtgattctgttctattttcagatttgttggcctggagttgtagtattctgcttcctcattcccatgttgcgtgtgctttccctttttgttctcattggtttttccagaattactctgtttcattgatcttttcaaataaccaactctgagatttatatcttaattttactgttttactatttcatgattcttttcgttttgttcttaattttttcctttattattttcccaccttcttaagttacatgccattttaactttttcttacttaataaaagacagttactaacattgtaaggtacgacttttcctctaaatacatctttatccatatctcttaaatttatatttagtgttctaagttataaataatttataatttcagatttgactttattttttactggagttttttgaaattatacttttaaatttccaggtagtttattttgttgttgttttttagcatttcttacaaacttctagttttattgccttgtcaaagagagtatggcctgtacaatttgtgtgcattttggagatcatggatgttttcttgagacctgatttttagttttaatacatatctccaggaaactgaagaagaaagcatattctctgaagggaacaaaattcaatcagatgtattcatttgaccttacaaagtataatattatggacctttaattttaatttacttgattcattaaggctaagaaagatatgttcgtctcctattattgtatttctgtctgtttcttttgtttctaacagtttttgctttgtttctttttgatgttatttggcaaatgatctttttatatttaagggaaaaaatattttcctttaaaggcttgtatacctttgtgaattttacctgattttgttgtaatagtttctgtagaaatacatagttcagtaaaatatttgtgtctgtttttaagtcaacagaaatctttcagaaatcctttgtatcttgacaagatactttggaagttcttgatctccctaagtaggctaatgtccttgcaggctactcctgaaccaaagcataagtggaagtgggggctggggcatattaggcttgggattttttgagtgtgccaatgtttctggttcttgctttggggcaaccccatgcttagggatgtttaggggatgcctgcccttcatctggtcatattctgcctcagtagggcccacacaaaggcaacctatgaggcacttttcttctgtggggactagccttctgagaaggcaggagaatgtagctttatatgcctggctattggggtaaaagctaatctcagagactcattccaccagataagattttggttttttttttctgtagagtcagagtcccgccatgttttccaggctggtcctgactcctgggctcaaatgatcctcctgccttggccttccacaatgccagaatcacaggtgcaagccaccatacacagcccccaccagaaaaggtttttccagagctgttggaacaggctattcacatggcaaagtctgtatcaaacacagaaccggcttttcccaaatgtgtaggagtggtgaatcccagccctcagctcaagagtaaaagaaataggaccttctctatttttccttcattcaagtgagtgttgatttttgagcccctgttccaccaggctcatgcaatttgactcagtcagcttcagcactcccctttctccagaggagagtcctttacagttctggggagcttacatattccaacatgttaaggggaggggattcacgtctgctgagatatccccgtttcctaccccgctggatacctcatgcctccatcccatgcttgggacataggaattagctgttctgtgctgtaggaatctccatgaagctgtacttggctctgcctgcctgggccctccctgtagccatgccctgtctggcgccacaatgacttcatttaacttgaagggactgctagataagcccaatgtgtgtttgcacgggagtcaagaccactgagtggaaataattctgtggctgccaccgatgctgtttgcattgccgagagccacagttctaccccctacttcccagcagtggccccgctgcgcctgccagagttgttaccatctctgtgccctttctcttgcttattgcacagtaggttacacagtcttgtgcttctccatcttgccatgtcatctcttcactctaccgctgctctgaccggcccatgcctaccctgttcccgtaccctccaggatctcctccgttttcgtattcctttaatgcagagctgccagaggcttcttcctaaagcatagacagatcaggtcctaggaccctgcaggctcttcccctgcctgcccaggccttgctgtgcactctccctgtgttcttcttgcttatgctgttccatccctggaatcctttcctgctccaactccattcctcttttaggccccaaaggccccagccctccggatgaaactaaaccactaccagggagggggacttgtgcctcttccatcgtccttttcatacttacagctgttaaatcattcattcatgttttcatttagcaaatatttattgtgcaccctcatgcccaggccctgggaacaccacagtaagaagactattactttccccagatctgctctgttccagtggaggggtgagctgctccattgcaggcgttcatggaactcagctgatgggggattttggaggctcccccacaaggcagagctctcataggcagccgacgacagaggccagtgtgcaccccacttctccagacttgggacgacctgggacattctgaagacctcatgaataccaggcttcaggatcgctgaccccaggaggagcccacggtggctctaagtgtacctgcttcgctgttcctgcgtcaccagcccactaaggtcctctgacttttgtgtagtagcatttttctaaggacaatctgcagagcagctgcttcagaactatttgtgttgccggcccatcccaaaaaaacctggatgaggacccttgcattctgggcctggaaatcttcattctagaaagctccttttactagacagaataatggtccccaaagatgtccacatcctaatccctggaacctgtggctatgttaccatagttggcaaaagggcccttcagatggagagatgatcctggattatccgggtgggcccagactaatcacacaagttctcagcagcagcagagaacctttccttgggtcagaaagagatgtgatgatggaagaagggtcagatacgatgctgctggcactgaaggtggaggaaggggccacaagccaaggaacaggggcaacctctagaaaccagaaagggcaaggaaatggcttctccccggagcctttagaagagaacacagccctgtcaacaccttgattttagcccagtgagacccatgtcagacttctgactatggaactgtaagataagaaatttgtcttttaagca

SEQ ID NO: 141350 - DNA, 555 bp, Homo sapiens
  Payload ID: 7786
  Gene Symbol: HOMER2
  Gene Name: homer scaffolding protein 2
  ENST ID: ENST00000558817
  CDS Start-End: 1-555
tttgcagagaaattccaggaggtgaaagaagctgccaagatagccaaagacaagacgcaggagaaaatcgagacctcaagtaatcattcccaaataattcactttggccaggaatctgggcgtgaaaccccatcttctactcaggcatccagtgtcaacgggacggacgatgaaaaggcctctcacgccggtccagccaacacacacctgaagtctgagaatgacaagctgaagattgccttgacgcagagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcata

SEQ ID NO: 141351 - DNA, 1384 bp, Homo sapiens
  Payload ID: 7787
  Gene Symbol: HOMER3
  Gene Name: homer scaffolding protein 3
  Uniprot ID: Q9NSC5
  ENST ID: ENST00000221222
  CDS Start-End: 68-1144
gggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 141352 - DNA, 1557 bp, Homo sapiens
  Payload ID: 7787
  Gene Symbol: HOMER3
  Gene Name: homer scaffolding protein 3
  Uniprot ID: Q9NSC5
  ENST ID: ENST00000392351
  CDS Start-End: 232-1317
ggcggcggcggcgcagacaaaggcacgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 141353 - DNA, 1418 bp, Homo sapiens
  Payload ID: 7787
  Gene Symbol: HOMER3
  Gene Name: homer scaffolding protein 3
  Uniprot ID: Q9NSC5
  ENST ID: ENST00000433218
  CDS Start-End: 100-1176
ggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtggc

SEQ ID NO: 141354 - DNA, 1979 bp, Homo sapiens
  Payload ID: 7787
  Gene Symbol: HOMER3
  Gene Name: homer scaffolding protein 3
  Uniprot ID: Q9NSC5
  ENST ID: ENST00000539827
  CDS Start-End: 654-1739
caataaccaggacaatgagaaatttacatctggatgtcagcggccaccaggctcctctcagagggccatctcctgtacagggtgttgtgggggcttcccctagacaaagaaagatggggtctgcttgctctgagttatctataataattatcttacctttttgtttctttttataatttctttcttttttgagacagggtctcactctcttgtccaggctggagtgcagtggcctgaccatagctcactgcactgcagccttgacctcctgggctcaagtgatcctcccacctcagcctccccagtagctgggacggcaggcacatgccaccacacccagctaattgtttaaatttttggtagagatggggtctcgccatgttgctcaggatggtctcgaactcctgggctcaaaggatcctcctgactcagcctcccaaagcaccaggtgtactttgggcctctcctgcctttttgattgaaagttccatgacgggcacacctggtgatgggtcctgagatggaacctgcttggcctccctcagcctggcctgagggacactcatagtccctcctctctccctaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 141355 - DNA, 1607 bp, Homo sapiens
  Payload ID: 7787
  Gene Symbol: HOMER3
  Gene Name: homer scaffolding protein 3
  Uniprot ID: Q9NSC5
  ENST ID: ENST00000542541
  CDS Start-End: 522-1607
aaacgctgcaagtcgcagcaggagctgccggaccggaagggcctgggttccggggacccctgtgttccccaactcccacccggcgcaggacccgcccccagtccaggccagagctgccgccccacccccactcaggggctccggtttcagaccctgtgaccaggacagcagctgcccaggacaggatagggggggcatcccccctttgaccacagaggccgctgggccagggcctcccctcccccacctgtcttccccctcctccaaactcctccttggtcccctgcagattcggggttgctgaatggcccaatggggaggttggggagccctggtctcccagtgtggattctgctctgccctcatggtgggcattgggattggctgtttgtctacatcttgtctttttaacttggctgggggctccctggggatttggactctggacttcaaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctga

SEQ ID NO: 141356 - DNA, 903 bp, Homo sapiens
  Payload ID: 7787
  Gene Symbol: HOMER3
  Gene Name: homer scaffolding protein 3
  ENST ID: ENST00000594794
  CDS Start-End: 208-666
acgggcggcgtggagggcggcgcggagggcgcgggcccgggagccagggagcgagcggggcgcccggcagcgcggagtcagcgccgcgggggccgcacccgactcgcgcctggacactcgcggggcgccgacctggcagggggccaaaccagtgctcctgccacctctctggctgccccctagagcctgcccatcccagcctgaccaatgtccacagccaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagc

SEQ ID NO: 141357 - DNA, 675 bp, Homo sapiens
  Payload ID: 7787
  Gene Symbol: HOMER3
  Gene Name: homer scaffolding protein 3
  ENST ID: ENST00000600077
  CDS Start-End: 224-675
agcgcggagtcagcgccgcgggggccgcacccgactcgcgcctggacactcgcggggcgccgacctggcaggattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcga

SEQ ID NO: 141358 - DNA, 982 bp, Homo sapiens
  Payload ID: 7787
  Gene Symbol: HOMER3
  Gene Name: homer scaffolding protein 3
  Uniprot ID: Q9NSC5
  ENST ID: ENST00000594439
  CDS Start-End: 1-978
atgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgacccccaccggtgagaaggaggggctgggccagggccagtcgctggaacagctggaagctctggtgcaaaccaaggaccaggagattcagaccctgaagagtcagactggggggccccgcgaggccctggaggctgccgagcgtgaggagactcagcagaaggtgcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccg

SEQ ID NO: 141359 - DNA, 770 bp, Homo sapiens
  Payload ID: 7787
  Gene Symbol: HOMER3
  Gene Name: homer scaffolding protein 3
  ENST ID: ENST00000599097
  CDS Start-End: 514-770
aggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaa

SEQ ID NO: 141360 - DNA, 866 bp, Homo sapiens
  Payload ID: 7787
  Gene Symbol: HOMER3
  Gene Name: homer scaffolding protein 3
  ENST ID: ENST00000596482
  CDS Start-End: 137-866
gcggcggccgcgtcgggaccggccgcgatgggaccggaggcggcgcgggcggcggcggcgcagacaaaggggccaaaccagtgctcctgccacctctctggctgccccctagagcctgcccatcccagcctgaccaatgtccacagccagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggccatcatcaacagcactgtcactcccaacatgaccttcaccaaaacttcccagaagttcgggcagtgggccgacagtcgcgccaacacagtctacggcctgggctttgcctctgaacagcatctgacacagtttgccgagaagttccaggaagtgaaggaagcagccaggctggccagggagaaatctcaggatggcggggagctcaccagtccagccctggggctcgcctcccaccaggtgcccccgagccctctcgtcagtgccaacggccccggcgaggaaaaactgttccgcagccagagcgctgatgcccccggccccacagagcgcgagcggctaaagaagatgttgtctgagggctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtggctgagctggaggctcaggcagcttcagaggtgaccc

SEQ ID NO: 141361 - DNA, 16389 bp, Homo sapiens
  Payload ID: 7788
  Gene Symbol:
  Gene Name: Homo sapiens Fc fragment of IgG binding protein (FCGBP), mRNA. [Source:RefSeq mRNA
  Acc:NM_003890]
  Uniprot ID: Q9Y6R7
  ENST ID: ENST00000628705
  CDS Start-End: 9-16226
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggctcaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcttgccacaagctggtggatccccagggtcccttgaaagattgcatctttgatctctgcctgggtggtgggaacctgagcattctctgcagcaacatccatgcctacgtgagtgcttgccaggcagctggaggccaggtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgatggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgcgggctgtatccccagcgacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctttcatctggcacagggggccccttcaccacctgccatgctcatgtgccacctgagagcttcttcaagggctgtgttctggacgtctgcatgggtggtggggaccgtgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccagccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcggcgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggagatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggcgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggcagctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgc

SEQ ID NO: 141362 - DNA, 8700 bp, Homo sapiens
  Payload ID: 7789
  Gene Symbol:
  Gene Name: Homo sapiens phosphatase and tensin homolog (PTEN), transcript variant 1, mRNA. [Source:RefSeq mRNA
  Acc:NM_001304717]
  ENST ID: ENST00000634767
  CDS Start-End: 513-2243
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgact

SEQ ID NO: 141363 - DNA, 3148 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000627384
  CDS Start-End: 425-1105
aagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagcgtctgttcctcacacaccccgcccaaggacgtgcctggcagcggcctggtgctccccgccgcagccacctcacccttgggtttctgtggccctgcagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatcct

SEQ ID NO: 141364 - DNA, 2984 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000629578
  CDS Start-End: 131-940
ggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatccta

SEQ ID NO: 141365 - DNA, 3200 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000625213
  CDS Start-End: 477-1157
aagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagatgtgctggactcttggggtccctttgaccctgtctgcgtctccctccccgtttggactctgccctgggctggattgagtggggacctgtacacagcctgggaggaggggaagcctatctccctgatagtctccttccagaagtgtccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatcct

SEQ ID NO: 141366 - DNA, 2863 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000629119
  CDS Start-End: 198-584
aagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgagattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagtgtgatcct

SEQ ID NO: 141367 - DNA, 715 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000625797
  CDS Start-End: 75-635
cagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctcagccgtctcagcagtagctacatcagcctgatggatagagacttcatgacgtgcagcagctggaacttttgtttataaagcatctcttttcctcaca

SEQ ID NO: 141368 - DNA, 1206 bp, Homo sapiens
  Payload ID: 7790
  Gene Symbol:
  Gene Name: Homo sapiens surfeit 4 (SURF4), transcript variant 2, mRNA. [Source:RefSeq mRNA
  Acc:NM_001280788]
  ENST ID: ENST00000626303
  CDS Start-End: 131-610
ggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaa

SEQ ID NO: 141369 - DNA, 1862 bp, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENST ID: ENST00000300302
  CDS Start-End: 99-1271
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 141370 - DNA, 1388 bp, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENST ID: ENST00000344114
  CDS Start-End: 99-797
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctg

SEQ ID NO: 141371 - DNA, 1782 bp, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENST ID: ENST00000379792
  CDS Start-End: 86-1186
gtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcaga

SEQ ID NO: 141372 - DNA, 2946 bp, Homo sapiens
  Payload ID: 7791
  Gene Symbol: HERPUD1
  Gene Name: homocysteine-inducible, endoplasmic reticulum stress-inducible, ubiquitin-like domain member 1
  Uniprot ID: Q15011
  ENST ID: ENST00000439977
  CDS Start-End: 198-1373
ctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcagagactcctgtcatcctagcagtttactctgcgtttgttgtatctagacagtcaacaactgagttgtcggtgtttaacctgaatgcttgtttttcagaagaggactgtttgtgccggtaagaatgatcaggtaaggccatgaaagtttttgttggcgtttttgtttttgagatggggtcttgctttgttccttgggccagagtacattggctactcacaagtgggctggtagctggctacagccccagactcctggcttaagccacctcctgcctcagccaccctggcagctgggactacaggcatgcgccatcacacttagcttgaaagttttaatttactaagaatatacctgtgtttccccccatttcctgatttaaacagtactggcttatataggaacccatcaaagttaaattccccaaatttaaatttagtaaatttagtggtttcaccttggcaaatctgcaatagtttcaccagctcaaatttcatgcttttgtaagctgagcttatgtttgtgattttaatcctttaagtactactgtggtaactaatcatttttttgttttttttggtggtgtttttgtttttgttttgagatggagtctcactctgttgcccaggctggagtgccgtggcgcgatctcggctcactgcaacctctacctcctgagttcaagcgattctcctgcctcagcctcccgaatagctgggattacaggtgcccaccacaatgtctggctaattttttgtatttttagtagagacgaggtttcacccatgttggccaggctggtctcaaacccctgacctcaggtgatctgcccgcctcggcctcccaaagtgctgggattacagatgtgagccaccgcacccagccagggactaatctttaaagcaaagttttatatatttttacgtgagtaatgttatgtgtaggtgttctatttggcaaaataaatcagccttttctatc

SEQ ID NO: 141373 - DNA, 567 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000563343
  CDS Start-End: 88-567
cacacaggagagggcatccgggcaggaaaagatagtgaagtcgtgagttccagcttgtggtagcgcctgtgtctgtttttgtttcatatggtcaagaatgttttagaacgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaa

SEQ ID NO: 141374 - DNA, 844 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000563911
  CDS Start-End: 1-680
ggggacagtatcctgaggattcctcaagtgatggtttaaggcaaagggaagttcttcggaacctttcttcccctggatgggaaaacatctcaagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaagg

SEQ ID NO: 141375 - DNA, 798 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000565966
  CDS Start-End: 99-260
agagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgt

SEQ ID NO: 141376 - DNA, 751 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000568358
  CDS Start-End: 1-329
aggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatagaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgta

SEQ ID NO: 141377 - DNA, 562 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000569429
  CDS Start-End: 112-562
ctgcccacgagcataattcttcatcacacaggagagggcatccgggcaggaaaagatagtgaagtcgtgagttccagcttgtggtagcgcctgtgtctgtttttgtttcatatggtcaagaatgttttagaacgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaacc

SEQ ID NO: 141378 - DNA, 458 bp, Homo sapiens
  Payload ID: 7791
  Gene Symbol: HERPUD1
  Gene Name: homocysteine-inducible, endoplasmic reticulum stress-inducible, ubiquitin-like domain member 1
  ENST ID: ENST00000568651
  CDS Start-End: 1-451
ccagcaggcattccaaggcctgggtcctggtttctccggttacacaccctatgggtggcttcagctttcctggttccagcagatatatgcacgacagtactacatgcaatatatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtt

SEQ ID NO: 141379 - DNA, 2005 bp, Homo sapiens
  Payload ID: 7792
  Gene Symbol: HGD
  Gene Name: homogentisate 1,2-dioxygenase
  Uniprot ID: Q93099
  ENST ID: ENST00000283871
  CDS Start-End: 461-1798
ctccaggagactcagcactgccctgttccttcctagcctgagtcaggactgagcagagaatcctccaccacacacagcaggcactatctgccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccaagtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtgg

SEQ ID NO: 141380 - DNA, 565 bp, Homo sapiens
  Payload ID: 7792
  Gene Symbol: HGD
  Gene Name: homogentisate 1,2-dioxygenase
  ENST ID: ENST00000475447
  CDS Start-End: 1-266
ttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattgattccttgggtcttcctaaaaggatgtctccccgttcaatgttgtggcctggcacgggaattatacaccctacaagtacaacctgaagaatttcatggttatcaactcagtggcctttgaccatgcaatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttc

SEQ ID NO: 141381 - DNA, 683 bp, Homo sapiens
  Payload ID: 7792
  Gene Symbol: HGD
  Gene Name: homogentisate 1,2-dioxygenase
  ENST ID: ENST00000494453
  CDS Start-End: 1-437
aggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaacctt

SEQ ID NO: 141382 - DNA, 462 bp, Homo sapiens
  Payload ID: 7792
  Gene Symbol: HGD
  Gene Name: homogentisate 1,2-dioxygenase
  ENST ID: ENST00000476082
  CDS Start-End: 37-462
aaatggctgagttaaagtacatttctggatttgggaatgagtgttcttcagaggatcctcgctgcccaggttccctgccagaaggacagctggctgtataggattctaccttcagtttctcacaagccctttgaatccattgacgaaggccaagtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcag

SEQ ID NO: 141383 - DNA, 631 bp, Homo sapiens
  Payload ID: 7792
  Gene Symbol: HGD
  Gene Name: homogentisate 1,2-dioxygenase
  ENST ID: ENST00000492108
  CDS Start-End: 1-297
gacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcaggatgtctccccgttcaatgttgtggcctggcacgggaattatacaccctacaagtacaacctgaagaatttcatggttatcaactcagtggcctttgaccatgcaggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgc

SEQ ID NO: 141384 - DNA, 5857 bp, Homo sapiens
  Payload ID: 7793
  Gene Symbol: HOOK1
  Gene Name: hook microtubule-tethering protein 1
  Uniprot ID: Q9UJC3
  ENST ID: ENST00000371208
  CDS Start-End: 258-2444
gcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacatattcaaaatataatgacactggaagagtctgttcaacatgtggtcatgactgctattcaagagttgatgagtaaagaaatattgagctctcctccaaatgatgctgttggagaattggagcaacagcttaaaagagccttggaagaacttcaggaagcactagcagaaaaagaagagctgaggcaaagatgtgaagaattggatatgcaggtgactacacttcaagatgaaaagaattcactggtttctgaaaatgagatgatgaatgaaaaacttgaccagttggatggctcttttgatgatccaaacacagtggttgcaaaaaagtattttcatgcacaattacaactagaacaattacaggaagaaaacttcaggcttgaagctgcaaaagatgattaccgtgttcactgtgaagaacttgaaaagcagctaatcgaattccagcataggaatgatgaattgactagtcttgcagaagaaacaagagccctgaaagatgaaatagatgttcttagggctacctctgataaagcaaataaactggagtcaacagttgagatatatcgtcagaagctacaagatctgaatgaccttcgcaagcaggtgaaaactttacaggaaaccaacatgatgtatatgcataatacagtcagcttagaagaagaattaaaaaaagcaaatgcagcacgtacacaattagaaacatacaaaaggcaggttcaagatcttcatgttaaactttcctccgaatccaagagggcagacacactagcgtttgaaatgaagcggcttgaagaaaaacatgaagctttacttaaggaaaaagagagactaattgagcagcgtgatactttgaaagaaacaaatgaagagcttcgatgttcacaagtacaacaggaccacctaaaccaaacagatgcatctgctacaaaaagttatgagaatcttgctgctgagattatgccagtggaatatagggaggtgtttattcgactgcaacatgaaaataagatgcttcgcttacagcaagaaggctctgagaatgaacgtattgaggaacttcaggagcagctagaacagaaacaccgtaaaatgaatgaactggaaactgagcagaggctgagcaaagagcgtattagagaattgcagcagcagattgaggacctccagaaatctttacaggaacaaggttccaagtctgaaggcgaaagttccagcaaattaaagcagaagttggaagctcatatggaaaaactcacagaggtccatgaagaattacagaagaaacaagaactcattgaagatcttcagccagatataaatcaaaatgtacaaaagatcaatgaacttgaagctgctcttcagaagaaagatgaagatatgaaagcaatggaggaaagatataaaatgtacttggagaaagccagaaatgtaataaaaactttggatcccaagttaaatccagcatcagctgaaataatgctactaagaaagcagttggcagagaaagagagaagaattgagattctggagagtgaatgcaaagtagcaaaattccgtgattatgaagaaaaactcattgtttctgcgtggtataataagagtctagcattccagaaactggggatggaatctagacttgtgagcggcggtggtgcctgcagtgacactggtgcgtgcactcctgcgcggtctttcttagcgcagcaacggcacatcaccaacaccagaagaaatctctctgttaaagtccctgctacaacatctgattaaactgcaaaaaaaacaaaacaaaacaaaaaaaccacataaaatagaagtgtccttaaaatattttgtacctttcaactaactaccagattgaaaaagagtttatgatgcgggatatcaggtattttaaaatcaacatgcatcaaattaattttgccagttgactttaaaaacaaattatagaattagccatctctctgagggagcacatttgaataattggagatgcagttatacacacatttcaaacaaacatttgtcttttgagagtattataatttcaaattggccttgtatattttagttaaatgttttcagttgtattagtaacttaattaattttcaatagctattcagtaatacttaatcttagaacattaattggatttgtttaatctttttttgttttttgttgatttatatgaaaacagtcttgaggcagggacatggagaactatgcaagggtgatttctttgacttaatatatacaaggctttacttctgtcccctaattcttccattgaatgtgtacctctaccttgtcatgtcatggaagatacaacatttggaagatctgacaattggaatgactttggaataataaaattgactaattggaaattttgcatattctgaaaatctaatctcatagttctaatttgtacctatggcaaataagggcttctggacatcatgtttaaaatgttaagcataagaaataaactgacatttgtaataggtgactttctgatggaaagcaagctatatatatatatatatatatatatatatatatatatatactttttgtgaaatgtctatatactttttaaggtaattaatgaagatttcagttattgcttttaagcataaagttgtatttagcttctgctgaaaaattgtatcatataataattttgcttcattgaaaagggatgttgcagtgatgaaacaaggtgggatcagtttgattttgtttacttattaaggagtttatcttgggctcagtttgtggtattcagttcgtttctgcccaaagctcttattttcagaggtgttacttttgaacttttggggtcatttttaaaagttagcacttttgaattttagttgtgttaaatatgtgctgtcgtatatcatagccatgagccatatatgacaatttaaatttaattaattataaactcagtctcttggttgcaccagccacatttcagatgctcaatagccacatgtggctagtgggtaccatattggacagggcagctatagaatatttccatcattgcagaaagttctattggatagtaccataatctttttatagtaacttggaaatactatttgatattagatgttagaccacaaaaagaagaaaaatgttaggactatttcagatataaaaaggaactgaattgtgacataattagcatcttacattccatacagttgaataccttatgctgtgacaaccatagttaatcatttcagtgctgttcaacatacatacctatcagcagtgtgtttagaccaggggtctgcaaactttctgtgaatggacaaagagtaaatactttagtaaatgtcttaggctttgtggcctacatgatctttgttgcaagtactcaactctgccattatagagttaaagcagccatacacaatatataaacaaaatgggcatagttgtatttcagtaaaactttatttacaaagacaggcggtaggccagatttggcttgcatgctgtagagctgtggtctaaattttattcatagactttctttgcaaatacagtgtgagtattgttccatttacagtattattattttttagatacctggtttttagattcttgcctggtaactttttactgaaaatacaagaatttcgtactgcatttgcatctccgagattagggagcacctgtcaggatatgttgttctatcagggttacttctgttgactacctcttagattttgatacagttatattgttgagtttcattttcatatattcttgtagtgtctgcttgcctgtgacttctggtaaaataaaataagcctttgaaaatattttagcatggtatttaacattttctaaatattatggcattttgacatattttagtcagcgaagacatctgcccctttggtgtttctacttgcttatgattgagattttacaagcccttcaaactccgttttaaaggaatttattgtaaaacattaactttaataaattagtgttttcacagatcagatcattatacttggaacttctaaatcatgcaatttctgaataaggacataaggctagattcatttttcttaatagagaaaaaggaaatttctgatttatcacttttctagttgataagtaggattcaaaacgtttgatatgtaagtatttatataagactaatgtaatttaaagttctgtattattgtgattaatcatacagaaattcaggaactgatcagaagtgagattcttttccacatctggttaatgtagtgagttgacaccctgtgggtggtaaagcattataaacatttcatcttgaaccatgatttatacacatctgtgttataagggaggcttgagtacatataccaatgaagagatattcagcatttgtctatttgataaggaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttga

SEQ ID NO: 141385 - DNA, 519 bp, Homo sapiens
  Payload ID: 7793
  Gene Symbol: HOOK1
  Gene Name: hook microtubule-tethering protein 1
  ENST ID: ENST00000455990
  CDS Start-End: 108-519
aggtcactcagggcggcggggcgaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctggctgcagacattcaatactgcctcaccttgtcaagatgtcaaacagctgactagtggagttgccatggcacaagttcttcatcaaattgatgcagcttggtttaacgaatcttggttaagccgaattaaagaggatgttggggacaactggagaataaaggccagtaatgtaaagaaggtccttcaaggaattatgagttattatcatgagtttttggggcagcagatttcagaagcacttatccctgatttaaaccaaataaccgaatgttcagatccagtggagcttgggaggttgctccagcttattttaggttgtgcgatcaactgtgaaaagaagcaagaacata

SEQ ID NO: 141386 - DNA, 2603 bp, Homo sapiens
  Payload ID: 7794
  Gene Symbol: HOOK2
  Gene Name: hook microtubule-tethering protein 2
  Uniprot ID: Q96ED9
  ENST ID: ENST00000264827
  CDS Start-End: 172-2325
gaggcggagcctgggcttgggggcggggcggggcctgcgcctaggggggcggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctg

SEQ ID NO: 141387 - DNA, 2513 bp, Homo sapiens
  Payload ID: 7794
  Gene Symbol: HOOK2
  Gene Name: hook microtubule-tethering protein 2
  Uniprot ID: Q96ED9
  ENST ID: ENST00000397668
  CDS Start-End: 75-2234
gctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagatgccatttccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 141388 - DNA, 965 bp, Homo sapiens
  Payload ID: 7794
  Gene Symbol: HOOK2
  Gene Name: hook microtubule-tethering protein 2
  ENST ID: ENST00000592079
  CDS Start-End: 288-965
cggcccttgtccccttcccccactatcctctccacccgctcccaggggctggagtctggaaaaccacgcgggaggaggttgtggggatatggacgagcatccgaggcccccggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaa

SEQ ID NO: 141389 - DNA, 748 bp, Homo sapiens
  Payload ID: 7794
  Gene Symbol: HOOK2
  Gene Name: hook microtubule-tethering protein 2
  ENST ID: ENST00000587178
  CDS Start-End: 122-748
ggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccag

SEQ ID NO: 141390 - DNA, 444 bp, Homo sapiens
  Payload ID: 7794
  Gene Symbol: HOOK2
  Gene Name: hook microtubule-tethering protein 2
  ENST ID: ENST00000586188
  CDS Start-End: 1-215
tggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacc

SEQ ID NO: 141391 - DNA, 729 bp, Homo sapiens
  Payload ID: 7794
  Gene Symbol: HOOK2
  Gene Name: hook microtubule-tethering protein 2
  ENST ID: ENST00000586719
  CDS Start-End: 284-565
ctcccaggggctggagtctggaaaaccacgcgggaggaggttgtggggatatggacgagcatccgaggcccccggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggcctcccccaccttgatccccagaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagaga

SEQ ID NO: 141392 - DNA, 607 bp, Homo sapiens
  Payload ID: 7794
  Gene Symbol: HOOK2
  Gene Name: hook microtubule-tethering protein 2
  ENST ID: ENST00000588052
  CDS Start-End: 225-607
aaaaaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcaggt

SEQ ID NO: 141393 - DNA, 801 bp, Homo sapiens
  Payload ID: 7794
  Gene Symbol: HOOK2
  Gene Name: hook microtubule-tethering protein 2
  ENST ID: ENST00000590839
  CDS Start-End: 330-801
gctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccc

SEQ ID NO: 141394 - DNA, 1097 bp, Homo sapiens
  Payload ID: 7794
  Gene Symbol: HOOK2
  Gene Name: hook microtubule-tethering protein 2
  ENST ID: ENST00000589400
  CDS Start-End: 288-1097
gggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgag

SEQ ID NO: 141395 - DNA, 14398 bp, Homo sapiens
  Payload ID: 7795
  Gene Symbol: HOOK3
  Gene Name: hook microtubule-tethering protein 3
  Uniprot ID: Q86VS8
  ENST ID: ENST00000307602
  CDS Start-End: 201-2357
cggtcccgagtgaaaggagaaggaggggcgctgggggtgacggtgcggagccgctgccagcgctgggcgagagtcggcggccggatccgaggagcaggcgggcctgaggccgagtcagctgcgcgggcccccggatcccccgacagagcggcggcggtgtctggccaggcggtaggcgctgcctggccgcggcggggaagatgttcagcgtagagtcgctggagcgggcggagctgtgcgagagcctcctcacttggatccagacatttaatgtggatgcaccatgccagaccgtggaagatttaacgaatggggttgtgatggcccaggttcttcaaaagatagatcctgcatattttgatgaaaattggctaaacagaatcaaaactgaagtaggagataattggaggctaaagataagcaatttaaagaaaattttaaaaggaatcttggattataatcatgagattttaggacagcaaattaatgactttacccttcctgatgtgaaccttattggggagcattctgatgcagcagagcttggaaggatgcttcagctcatcttaggctgtgctgtgaactgtgaacagaagcaagagtacatccaagccattatgatgatggaggaatctgttcaacatgttgtcatgacagccattcaagagctgatgagtaaagaatctcctgtctctgctggaaatgatgcctatgttgaccttgatcgtcagctgaagaaaactacagaggaactaaatgaagctttgtcagcaaaggaagaaattgctcaaagatgccatgaactggatatgcaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgagacattcttctgataaagtatctaaactagaaggtcaagtagaatcttataaaaagaagctagaagaccttggtgatttaaggcggcaggttaaactcttagaagagaagaataccatgtatatgcagaatactgtcagtctagaggaagagttaagaaaggccaacgcagcgcgaagtcaacttgaaacctacaagagacaggtagtagaactacaaaacagattatccgaagaatcaaagaaagcagataaactagattttgaatataagcggctaaaagaaaaagttgacagtcttcaaaaagaaaaggacaggctgagaacagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttccatattgacttatgtatttggtcccaaattatatttaagtcttttttcttgcaacgtagcccattttttgaaagcaaaacatttctgaaattaggtcatggtttttttgtttatttttaggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctttctttctttttaataagaaagatgacctaaaaatcagtggtatttgtttgtcctcagaagccgtagttgaagaaagatattagagtatacacagaactggagccatacattgtgctaattttttacattaagtacagaagtctgagcacagcatgaatgcttctgcctgacaggaccacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtggatcacttgaggtcaggagtttgagaccagcctggccaacatggtgaaaccccatctctactaaattacaaaaattagctgggcatggtggcatgtggctgtaatcccagctacttgggaggctgaggcaggagagtcacttgaactcaggagccagagactgcagtgagctgagatcgcaccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcagtggctcacgcgtataatcccagcactttgggaggccgagacaggcacatcatctgaggtcaggacttccagaccagcctgtccaacatggtgaaactccgtctctactaaaaatacaaacaattagccaggcatggtggtgtgtgcctgtagtcccagctacttgggagggtgaggcaggagaattgcttgaacctgggagacagagattgcagtgagccgagatggcgccattgcaccccagcctggcgacaagagcgaaactctgtcgcaagaaaaaaaaaaaaaaaaaaaaaaaaaaaaacagtctgtgaactactcactgaatgaattttgttctgtgagatgagaggttttcattttcattttctatttacagccccagtcctaatctcctacccatccacctacccagatattttttctctatctgggttggaaaggccccaggcttttagaggggagttttacttctgacttttttttccccccgagacggagcctcgttccgtcacccaggctgtagtgccgtggcatgatctcggctcactgcagcctctgcctcccgggttcaagcaattctcctgcctcagcctccagagtagctgggattacaggtgcccaccaccatggctggctaatttttgtaatttagtagagatggtgtttcaccatgttggccaggctggtctcaaactcctgacctcgtgatctacccacctcggcctcccaaagtgctgagattacaggcacgagccaccgcgcccagtcgtacttctgacttttcttcagcatctgttgtatgctattattttgatgtttacatttataattttctttcttttttttttttttgtgagatgatgtctcgctctgtcacccaggctggagtgcagtggcgcgatctcggctcactgcaagctccgcctcccgggttcacgccattctcctgcctcagcctcctgagtagcggggactacaggcgcccgccactacgcccgactaattttttgtattttttagtagagacggggtttcaccatgttagccaggatggtctcgatctcctgacctcgtgatccacccgcctcagcctcccagagtgctgggattacaggcgtgagccaccgcgcccagcctacatttataattttcattctcttttacctataaaattcagtgtattagtttcattacataggagaaattatatttctaaacattttatgatgtttaaaaacaaaacaggctgttgtaaaaaaaaaaaaaaaaaaaacttctgaatatactttaggtatcagaaagccaagaataaaatttagctctaacggtggcaactccatgtccggtgtccagctttggacagggtttatgacgtttctgtttctctagtaatgattaatgattcctcaggagattcgtgatgttgtctggtctatctggaaatttaaagtcactaggagctttgcctcatcgtgagtgatgctgtgctgtatttttacaaactctcgcatacagcaccttcctggggccacgttggcttgtgcagtggagcttgtccaggcaccagcatggagcaagtacagggttgctgtgttgggttggagcacactgtcaccacagtgtctgaagtcttataaacaggaagatcattttctgttttccttctaaccagggtgagaaaatacaaagtaaagaactaaagaatattaaaacctagcatttatgttccacagtgtgtatttcagaagtttgtaatccagaaaatatagtagtgtataatatctgaaaagagaatcaagtatacaattgtacatatttttaaagaactttgaaaaactccgtcatatcttttaccatttgtctatttgatagtaatgcagaaaaaagtccctaaagaccctgtgttccaaaatttaccaagattgacatttctattagacatccttaacctaagtgttttaattagattattagactataataaggatgaaattgctgtctgtaattttgttgaggttttattgttaatataataaaagctcaactgtacaaaattaagctaaatgttatccagtcagaaacatcagcctgtggccaggtgcggtggctcacgcctgtaatcccagcactttgggaggccaaggcaggcggatcacctgaggtcaggagttcaagaccagcctggctaatatggtgaaaccccatctctactaaaaatacagtattagccaggcatggtggcaggcgcctgtgatcccagctacttgggaggctgaggcaggagaatcatgtgaacccaggaggtggaggttgcagtaagccgagattgtgccactgcactccagcctgggccacagagtgagactccatctcaaaaaaaaaaaaaaaaaaaaaaagaaacatcagcctgtatattccagtagttctcacagaagaatgaaaatccgtgctgtgcaaatagatcagtagtgagtgagtgttaagtgaaagatgagctaggttgaagaaaatatacattttattgatgagccactttgctatctctccttccttcctccttccttccttccttccttccttccttccttcccttcttttcttttttcttttcttttcttttctccctcctttcttccttcccttcccttcccctcccctcccccaggctggagtgcagaggcacgatcctggctgactgcaaactctgcctaccaggttcaagcgattctcctgcctcatcctccctagtagctaggattacaggcatctgccaccacgcccagctaatttttgtatttttacaaaatacaaagagacggggtttcaccatgttggccaggctggtctctaactcctgacctcaggtgatccgtccaccttggcctcccaaagtgctgggattacaggcgtgtgttactgccccagcctcctatttccttttcgaaagtagcagtttggtttattctcgtttgctaagtaattgtttgaaatatttttcagcctctcctgctccctcacaaaaattcacctgtcattttaatgataacagcatgttaaaaacttggaagtctttatcccaatataagaattatcttgaaacaaaaatctaaattacttttaaaaattctcttaactctgcatttagtctcctattatctagatctctgagtccaggataactccagttatccccagttggatcatgtgtgatttatctgagaaagcatccacaacccacagctagtggaaaccgagctagtttacagccacgtggataagaacatctttgtttctaaagtgagaggaaagtgcttggtatcttgctttttgctgagggcaaaataacaacatgaagacaaagtgctttttgttgtctattcatgaaactgtagaagaatattttgagtttttattcttatattatgaagggattctttgcctagcagtggccgtcaaactgatgtagcattgtacttctcaacagtgaagcctgtgtaataccatacagtaggatgaaagactattctgagcaaaatcaaatgggatgtcagaatctttgaaaattattttatcattttttctattttttcatttttataaattagaaggattttccattcaataaggataatctctcttcctatcattctgtcaaaatggcagtttcttttggtaattatccaacctagtttcattacatttagaaggaggtttcagagcttattcttgataactataataatgatttgaatgttttatatcatgaagttttttctatgaggaaggctattctcaatgtatctgtcgtctaattttttattttctatctataaagaatatttaaataataattggtgtatgttccttttgttgaaaatgttttattgtccagttttaacacagaagtggtctaaagttttgcagcaaatgctgttcagttcccagaagcctaaaaaacataacataatatgctaacagagctaatttccacccaatccctcaaattaccgaagtattaatatttagcttcctttctagaaaacaaggggcagcacaaatggggtggcatccatctcttttaaatcactgatgattttctggggaagtatatatagatgattttattttttaaatagccttttatcaaaccatttcacatgtattatctatatgactatagaaacttataaaacatttaattcatgttgacttaaaacatgggcatccttggattctccacattgactgaaatgatagagaaagggacatttgtttgagaaacaagagacctgtacctaattatggcaagtatatgagttttggtgattgtggggggttataaatgttttcctatgatagataaatatatagatatagatcaggaattacttgatgtctcttcagaagttttctgttttcttataatttccagtaatactctgtaagactcggtttgcatgctgtgtgtgtttgcatgagtatagaaacctaagaacataatggaaggctattaaggcaaattcattcctagaaagtggagtggatcattgggataagaaatagcctaattataaacaaatatgcaggcagagggaagtcctaatacaatgaaaacttgcattatctaaacagatgttcccaaagcaatagtttgcctaaaatcctctgtattacatgattattcagtaaaagagtaaacaaatatctaatttattttctaattgtccttcccttcattgagtattaactaggtgcataatgtagttgtatatgtttactagtaaagggaaaaacacttattttcattttgagactgtttggctattactaaagctgagaaagtgattttaggtcgccaaggatactatgatttgatgagatgagaagaaatctgcggtggctgaaaatcgtgaccaacttggtgttatctagatctgctttatctagtttgcaagccataggctcaattttatgtccttcttacttacacacagtagccccacacagttttgttttaaatgaaggcaaaagtagacatttttaaagtatattcaacattgtgccattatttacctgataaaggtgaaatcagaggtgtccacggcctcaaagtttgggcccatgggactatcaaatccgaattatatctacttagagcttagaggaagaattaggtatcatgagaaaagcaactcctacttgagagaaagaagactaccaaagcatgttgaggctttaacatgggagacttccaggtaggcgttaacacttgagtggtaactagcttgatgaaggaaaataattactttagcagttatgttgtaaaattaataaaaaggactcatgtttattctggtgtatttgtcaacccatgggtagtgattactccgtgtacattctatagtgtgtgtattttatttagtgtcttaatatatagtctttatatagtatcttaatattatttactgttacttctagtcatttatgtagtatattttactgcaaaatttgtagcactttactaatattagatcattattttccctcttcccctctacctttctggcattttctgttatcttagagtcaggaatctaaaggtctaagtctagaaatctgttggaagctgggttggagctactggatatgagttactttttacatgtctccttaagaagactcttttataatgtaatacttagaagccaaatcctttcaaacgcaaacacccttgaaacttgatgctttctgaagttgtattcataaaaattatcccatcttacagttaatcagaagatgttcttacctttggtttgcctgcctcctgaaacacaaacctgcagattgcccctaacttcagcagtgcctccgtcactgcatgtacctaaaagacaggaaagccaagttctgggagctgtcaagtcggaggatcaggaaaatggtggggaagaggtgactggaaaggcaggcactaaagatggcaggctgcaaaagcattctgagttcccctgtaacagataggttttatgaactcagctgttttcttttttctttttttttcttttgagatggagtctcactctgagtctcactctgttgcccaggctggagtgcagtggcacaatctcagctcactgcagcctccacctcccggtttcaagtgattctcccacctcagcctcccgagtagttaggattacaggtgcccaccaccacgcccaactaatttttgtatttttagtaaagacagggtgtcgccatattggctaggctggttttgaactcctgacctcaggtaatccacccgcctcagcctcccaaagtgctgggattattataggcgtgagccaccatgcccagtgaacttggccattttcttacattcatatatagcaaagttttcaacttgtctaccgagagactttctttaggagccaggacttctacatttgtaacttgagtatattaatattcaaatcatagttcaaaaatactgaaatacttgtttattatgttacataaatatggacacaattactgccaaagaatagagagatttgcttatgagaacattctgtcatttgttctgtttgtagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaattagaaaattaaaagtgaaacataacacataaggacgaaatacaatgttctgaatatcttccactaattaattgttgaatgattaagtctctaagtatcttaacttccattgtcttcttgttaacctagacaagagtagattattcagtagccacatgtgacagttaaaattaagtaaaattaaaactatagtttctcagtggcctagccacatttcaagtgttccacagtcacatgtggatagtagttacctatcagacagtacaggtatagaacatttccagtattgccaaaaatgctattcaacagcacttttattgcccagagagaaaataaggacaaaataaaggcagtgaagtaacttaagacaactctgagattttaccaccatacttagagaaagtttttctgttataaaaattaatactaatcctttttaaagaccttggaaaaaatcaaaaccccattcctttaagctagtcttcagtatatatttttctaagaacagattctcaatactttatttttcaagtgataaaatcattttataaatcatttcttaatatcttcagtgttttttccctttttatgtaaactcttttaaaattgatattagctgggcatggtagctcatgcctgtagtcccagctactccagaggtcgaggcaggagcatcgcttaagcccaggaggttcaggctgcagtaaggtctgatcacacctgactgcactccagcctgggtggcaaagcaagacccctgtctctaaaaaaaaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattca

SEQ ID NO: 141396 - DNA, 774 bp, Homo sapiens
  Payload ID: 7795
  Gene Symbol: HOOK3
  Gene Name: hook microtubule-tethering protein 3
  ENST ID: ENST00000533338
  CDS Start-End: 1-94
aggctcagggcagtcatttctggcgaggcagaggcaagcgaccagcagcagaagatcatacccaggccacgtgcagccggccacagcaagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaattagaaaattaaaagtgaaacataacacataaggacgaaatacaatgttctgaatatcttccactaattaattgttgaatgattaagtctctaagtatcttaacttccattgtcttcttgttaacctagacaagagtagattattcagtagccacatgtgacagttaaaattaagtaaaattaaaactatagtttctcagtggcctagccacatttcaagtgttccacagtcacatgtggatagtagttacctatcagacagtacaggtatagaacatttccagtattgccaaaaatgctattcaacagcacttttattgcccagagagaaaataaggacaaaataaaggcagtgaagtaacttaagacaactctgagattttaccaccatacttagagaaagtttttctgttataaaaattaatactaatcctttttaaagaccttggaaaaaatcaaaaccccattcctttaagctagtcttcagtatatatttttctaagaacagattctcaatact

SEQ ID NO: 141397 - DNA, 485 bp, Homo sapiens
  Payload ID: 7795
  Gene Symbol: HOOK3
  Gene Name: hook microtubule-tethering protein 3
  ENST ID: ENST00000533539
  CDS Start-End: 1-485
gaagaattacaaaaatctttacaggatcaaggctcaaaagcagaagatgctatttcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagaggaagaaatgaagcaaatggaagaacgatacaaaaaatacttagagaaagccaaaagtgtcatccgtactttagatcctaaacagaatcaaggagcagcaccagaaatacaagctcttaaaaatcagctccaggaacgagaccgactgttccactcattagagaaagaatatgagaaaacaaagagtcagagagagatggaagagaaatatattgttagtgcctggtacaatatgggaatgaccctgcataaaaaggcagctgaagatag

SEQ ID NO: 141398 - DNA, 598 bp, Homo sapiens
  Payload ID: 7795
  Gene Symbol: HOOK3
  Gene Name: hook microtubule-tethering protein 3
  ENST ID: ENST00000526882
  CDS Start-End: 1-305
cagaaagggattctctgaaggaaaccattgaagagcttcgttgtgtacaagctcaagaagggcagctcacaacacaagggttaatgcctcttggaagtcaggagtcttcagacagtctagctgcagagattgttacacctgaaatcagggagaaacttattcgtcttcagcatgagaataagatgttaaagcttaaccaagaaggttcggacaatgaaaaaatagccttattgcagagccttctagatgatgcaaatctacgcaagaatgaactggagacagagaataggtacttgtgcccataaatttccctcttactacggcttttgctgtatcccatagatttcggctggtgaatcaaagacttctggaagtacagtcacaagttgaagaattacaaaaatctttacaggatcaaggctcaaaagcagaagattcagtccttctaaaaaagaagcttgaagaacatctagagaagctgcatgaggccaataatgaactacagaagaagagagccattattgaagatctcgagccaagatttaacaacagctccttaaaaattgaagaattacaagaagctttacgaaagaaagag

SEQ ID NO: 141399 - DNA, 1129 bp, Homo sapiens
  Payload ID: 7796
  Gene Symbol: HOPX
  Gene Name: HOP homeobox
  Uniprot ID: Q9BPY8
  ENST ID: ENST00000317745
  CDS Start-End: 186-407
gaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141400 - DNA, 1611 bp, Homo sapiens
  Payload ID: 7796
  Gene Symbol: HOPX
  Gene Name: HOP homeobox
  Uniprot ID: Q9BPY8
  ENST ID: ENST00000337881
  CDS Start-End: 658-879
acagatgcaggggaaataaatgagaatcgtttttgagggagacctaaaactgtatcatcctagcccgaatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactga

SEQ ID NO: 141401 - DNA, 1164 bp, Homo sapiens
  Payload ID: 7796
  Gene Symbol: HOPX
  Gene Name: HOP homeobox
  Uniprot ID: Q9BPY8
  ENST ID: ENST00000381255
  CDS Start-End: 221-442
ctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141402 - DNA, 1141 bp, Homo sapiens
  Payload ID: 7796
  Gene Symbol: HOPX
  Gene Name: HOP homeobox
  Uniprot ID: Q9BPY8
  ENST ID: ENST00000381260
  CDS Start-End: 68-352
cgcaccagatctacgctttgaaatgaggcaacatctaactggaaactcgctcaaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141403 - DNA, 1543 bp, Homo sapiens
  Payload ID: 7796
  Gene Symbol: HOPX
  Gene Name: HOP homeobox
  Uniprot ID: Q9BPY8
  ENST ID: ENST00000420433
  CDS Start-End: 536-811
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactga

SEQ ID NO: 141404 - DNA, 904 bp, Homo sapiens
  Payload ID: 7796
  Gene Symbol: HOPX
  Gene Name: HOP homeobox
  Uniprot ID: Q9BPY8
  ENST ID: ENST00000508121
  CDS Start-End: 238-459
agaatcgtttttgagggagacctaaaactgtatcatcctagcccgaatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaataca

SEQ ID NO: 141405 - DNA, 1248 bp, Homo sapiens
  Payload ID: 7796
  Gene Symbol: HOPX
  Gene Name: HOP homeobox
  Uniprot ID: Q9BPY8
  ENST ID: ENST00000503639
  CDS Start-End: 305-526
cgcaggcagggatacagttcctgcaaggggtcccggggggcgcgggaggcgcaggacgctaggctctgccgtcagcccgcaacagcgctcagtccagggagggaggcccgggtggggggcagccgtaagcccccgctcagcgtgcagccaccggggacttgcgcggccgtggcaccgctggagggggcggcctggggctggggctgcccggcggcgccgcgaccgccttccttcgctgcgtcccgcccgctccacgcctcgctcaccgccgccgcttctccctgccccgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141406 - DNA, 1672 bp, Homo sapiens
  Payload ID: 7796
  Gene Symbol: HOPX
  Gene Name: HOP homeobox
  Uniprot ID: Q9BPY8
  ENST ID: ENST00000554144
  CDS Start-End: 536-874
gcaccagatctacgctttgaaatgaggcaacatctaactggaaactcgctcaaagtaaggaagtggatgagaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctatgctcattttcctgggctgttacagaagaagactggaagagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactg

SEQ ID NO: 141407 - DNA, 1064 bp, Homo sapiens
  Payload ID: 7796
  Gene Symbol: HOPX
  Gene Name: HOP homeobox
  Uniprot ID: Q9BPY8
  ENST ID: ENST00000556376
  CDS Start-End: 121-342
ttccaaacccagggcttgcgcttgcctttgcctcttccacagtttctccaaaataaaaaaaaaaagaaaagaaaaacaaatgacaagtttgcaagactgataaaacagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141408 - DNA, 1138 bp, Homo sapiens
  Payload ID: 7796
  Gene Symbol: HOPX
  Gene Name: HOP homeobox
  Uniprot ID: Q9BPY8
  ENST ID: ENST00000556614
  CDS Start-End: 195-416
gcggagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141409 - DNA, 1139 bp, Homo sapiens
  Payload ID: 7796
  Gene Symbol: HOPX
  Gene Name: HOP homeobox
  Uniprot ID: Q9BPY8
  ENST ID: ENST00000555760
  CDS Start-End: 196-417
gagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcgcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141410 - DNA, 1001 bp, Homo sapiens
  Payload ID: 7796
  Gene Symbol: HOPX
  Gene Name: HOP homeobox
  Uniprot ID: Q9BPY8
  ENST ID: ENST00000553379
  CDS Start-End: 58-279
cggctagtcgcggactcgggcgaacccaccctcgcgatctgtcaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaa

SEQ ID NO: 141411 - DNA, 1771 bp, Homo sapiens
  Payload ID: 7797
  Gene Symbol: HORMAD1
  Gene Name: HORMA domain containing 1
  Uniprot ID: Q86X24
  ENST ID: ENST00000322343
  CDS Start-End: 116-1279
ggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaa

SEQ ID NO: 141412 - DNA, 1692 bp, Homo sapiens
  Payload ID: 7797
  Gene Symbol: HORMAD1
  Gene Name: HORMA domain containing 1
  Uniprot ID: Q86X24
  ENST ID: ENST00000361824
  CDS Start-End: 107-1291
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggc

SEQ ID NO: 141413 - DNA, 791 bp, Homo sapiens
  Payload ID: 7797
  Gene Symbol: HORMAD1
  Gene Name: HORMA domain containing 1
  ENST ID: ENST00000368987
  CDS Start-End: 220-791
ctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgttctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatga

SEQ ID NO: 141414 - DNA, 1794 bp, Homo sapiens
  Payload ID: 7797
  Gene Symbol: HORMAD1
  Gene Name: HORMA domain containing 1
  Uniprot ID: Q86X24
  ENST ID: ENST00000368995
  CDS Start-End: 256-1200
atgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgttctagctacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgta

SEQ ID NO: 141415 - DNA, 740 bp, Homo sapiens
  Payload ID: 7797
  Gene Symbol: HORMAD1
  Gene Name: HORMA domain containing 1
  ENST ID: ENST00000442853
  CDS Start-End: 248-740
cgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcac

SEQ ID NO: 141416 - DNA, 2187 bp, Homo sapiens
  Payload ID: 7798
  Gene Symbol: HORMAD2
  Gene Name: HORMA domain containing 2
  Uniprot ID: Q8N7B1
  ENST ID: ENST00000336726
  CDS Start-End: 356-1279
gttgtataggtggcccaggctggcggcccctgaccgaaggtcgcgtcgggtcagtgtgcagcccgtggctgagaggcggctgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaaga

SEQ ID NO: 141417 - DNA, 2115 bp, Homo sapiens
  Payload ID: 7798
  Gene Symbol: HORMAD2
  Gene Name: HORMA domain containing 2
  Uniprot ID: Q8N7B1
  ENST ID: ENST00000403975
  CDS Start-End: 286-1209
actttagtgaggatttgccaattaatccctatggactttagttccctaaacagagggagagagtcttgaacctcaggattagccaatcgccaaaatgtgtccgagtacgcagggcactggacaggctgtgcagtacatcgtgtactcagctggtagaaatgaggggtggttctggcccctaaaggggtttttaatctcagcaggatcataatctaatttctcctccattggaccatcaatctgttgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaa

SEQ ID NO: 141418 - DNA, 658 bp, Homo sapiens
  Payload ID: 7798
  Gene Symbol: HORMAD2
  Gene Name: HORMA domain containing 2
  ENST ID: ENST00000450612
  CDS Start-End: 58-333
ggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatgctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaa

SEQ ID NO: 141419 - DNA, 7385 bp, Homo sapiens
  Payload ID: 7799
  Gene Symbol: HUNK
  Gene Name: hormonally up-regulated Neu-associated kinase
  Uniprot ID: P57058
  ENST ID: ENST00000270112
  CDS Start-End: 361-2505
ggcgccgccggaccgcgccccaccccgcgcgcccgagcagggcgactgtcattagcttcctggacgggacccggggcgggatcctggtgtcctgaaaggggcccgggcgaccctaagaggaagaacttttgggggcggggtccccggtcccgcgtcccctgggcagccgctattgtctacgcgcctcgctgggcggcgcggggggcgtgatcgcggcggccccgggctctgggtgcggagacccaggcggggctgggcccagggcggcggcgggagaagccggggaagccgaagagcctggggaggaggagctgcgagcgcgggagacgagcaggagccgcgcgggccgcggcgagcgcgatgccggcggcggcgggggacgggctcctgggggagccggcggcgcctgggggcggcggcggcgcggaggacgcggccaggcccgcggcggcctgcgagggaagtttcctgcctgcctgggtgagcggcgtgccccgcgagcggctccgcgacttccagcaccacaagcgcgtgggcaactacctcatcggcagcaggaagctgggcgagggctcctttgccaaggtgcgcgaggggctgcacgtgctgaccggggagaaggtggccataaaagtcattgataagaagagagccaaaaaggacacctatgtcaccaaaaacctgcggcgagagggtcagatccagcagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccataggtgtgaacatgtatgccatgttgaccgggacgctgcctttcacggtggagcctttcagcctgagggctttgtaccagaagatggtagacaaagaaatgaaccccctccccactcagctctccacaggtgccatcagtttcctgcgctctctcctggaaccggatcctgtgaagaggccaaatattcagcaggcactggcgaatcgctggcttaatgagaattacacgggcaaagtgccctgtaatgtcacctatcccaacaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaagattcctttggctgccgcaatattttccgcaaaacctcagattccaattgtgtggcttcttcttccatggagttcatccccgtgccaccgcccaggaccccgaggattgtgaagaaaccggagccccatcagccagggcccggaagcactggcatcccccacaaggaagaccccctgatgctggacatggtgcgctccttcgagtctgtggatcgcgacgaccacgtagaagtgctgtctccctctcatcactacaggattctgaactccccggtcagcttggctcgcagaaattccagcgagaggacgctgtccccgggtctgccatccggaagcatgtcgcctctccatactcctttgcatccaactctggtctcttttgctcacgaagataagaacagccccccaaaagaggagggcctgtgttgcccacctccggttcccagcaatggccccatgcagcctctggggagccccaattgtgtgaaaagccgaggccggttccctatgatgggcatcggacagatgttaaggaagcgccatcagagtctgcagccatctgcagataggcccctggaggccagcctgcccccactgcagcccctagcccctgtgaaccttgcctttgacatggccgatggggtcaagacccagtgctaacttgggccagcggggtttggggtatctctagaaaacagcaactgaacagagctccacacatctgtcagggtgtgagcactccaaggcctcgcgtggagcatccttagtcccacctgtagctgaatccacagacccaaagcctgcacaacccaacctcgcttagggacccccagagatgctggaatcgctaggagggttggctccaggggcagccaattcctatcattcagatcttccttcctcccaagtactcaccaaccccttccacttcccacttcccccaggcttggggggaaaacagggcatgagccttctggggcactcagattatggactgttaccagatctttcttcacgctgtgctacatgtgtgcctctcacagcagttggccacagttacagggagagaacaatatcacagtcattcatccaggccacgtttcctctgcggagtgtagcagccctgcctttcatagcagggattacctgaaggccagcaggagccgggggcaggcccaggatcctcagaggaagatggagaggagcttcggaccaagatcaaaccaaacagtggggaccccaacagaagagaaagactgaaggagacactcatttcccaagcaagattttgatagatttttgttgttgttgttgttgaaacatgctaatgattgaattatcttttccaaagattttttttaaatgtgatgtcggtaaattgaaataacataattttttaaaacttggatggagagatgagaagcaattccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtggctcacacctgtaatcccagcactttgggaggccgaggcaggtggatcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagaggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtctgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactacgactgcttctttatttgctgataaatcttaaaacaactaagtacgttgcaaataatagtacaggtaccatcttttatgtgaagttctttttctttttttgagacagggtcttgctctgtcacccaggctggagtgcagtggcacaatcacagttcactgcagcctcaacctctccagattcaagtgatcctcccatctcagcctcccaagtagctgggactacagttgtgcaccacaatgcctagctaattttttttgtattttgtagaaatggggtttcgccatgttgctcaggctgatctcaaactcctgggctccaacgatctgcccaccttggcctcccaaagtgctgagattacaggcgtgagccactgtgcctggccttatgtaaagctcttgacctagcatctgactggaaacaagcgggaattgcattggggggcattttctgggccagtttccctgccttattttacctgcaataggtgtgcctacaaaagtctttctgacatacacactgcaggtggcagttcaagaagaatcaacctttttcatttggggatattaggatcttccttggagactctgaaaatggcacacaaagaatggcagttatgaacgtgacttctagattttgtccttgtaggaggccttggtcatggataggggaagagggatgatgggatggaatgggagggtgggatctagatgacctcttgaaattgtcccagttactgcttccttcataactgttcacaaaacgtttttcatatataccaccttgtttcccctgggaagtgaggggacgaagccttagagggtgacatagctagaaagtggagaagctcactgttcactgtgcaaagccccagtagtcggattccggggaaaagaacaagtatctagttttgatgacaatgttttcttgtaagaatcccaacactttagaatagaaaaggacctaagattctctggctcagccccagcctttctgaagaagggaaaactagggacccagatggtttaaggacaccccagagtccccagatgagctggcatttgagctggtctggagcagagtttctccctcaaagaacacagagaaatcagagagtggctgccatggtcagagggggatgtcaacaacagatcaagccgtcatcacaacaggtatttctgaagttcctgcagggactaggtcttgcatttttaagtccttttcaaaactgtgcagcttcctgaaccttatgctgtttgtcccatccactcttgaagctggggaaagacagctttctttgggaactctgtctttctcagttgacttcccaagtaagcagcaaacccctggatagccttgttatctactttaggtattaagaggctattgggttttactagattaaatcaataaaacatttcctatagagccatatcatacactgaagcaaattcagaaagaatgcaaaactgctatcttttgggggagtctggaagcctgttggttagtgtatttattttctttgtggggtcttctgtgagctacaggcacagtaagaataattcagagcggtactgggagttggttcaatttcatgtcatcacttttcaatgaagggagtgcatttcctgagtagtaaatgagtatattatttgtggcagcttttctgttaagggagctttccagacatctggttgcaaagacaaataggatatatatttgtacttcttctctgtggacatgtttttgtgacacacagttatctctaggagttgacgtctgtgggcactaagggactgaggttgggggagaaagctgaggaggctttggaagagaaggtgaggagcatttcaggatttgcagtccccctccacatgtatccacatctgagctggtggtgttccaataatgaggcatttggggcaaccaattttggaaggatagaatagctttatgtggagcaaacttgaggatcaattggagttgagtggtttaaaacttaaagatggcacaggaagctgtatcatttacaggtgaaaaaaataaatgggtctgacttca

SEQ ID NO: 141420 - DNA, 860 bp, Homo sapiens
  Payload ID: 7799
  Gene Symbol: HUNK
  Gene Name: hormonally up-regulated Neu-associated kinase
  ENST ID: ENST00000439107
  CDS Start-End: 1-339
cgctatttgtcagggaaatctgacatccaggacagcctctgctacaagacccggctctaccagatagaaaagtacagggcccccaaggagtcctatgaggcctctctggacacctggacacgagatcttgaattccatgccgtgcaggataaaaagcccaaagaacaagaaaaaagaggggattttcttcatcgaccattctccaagaagttggacaagaacctgccctcgcacaaacagccctcaggctcgcttatgacacagattcagaacaccaaagccctcctgaaggaccggaaggcctccaagtccagcttccccgacaaaggactctcctgaggatggaggcccttgtcaccgggcatcttgaaaggacatcctgccattgttcacaggactcaactacagactgctcttccagatcttgaaataagtaccccctggcctggctcaggagcctgctaggacctgcacaagatggtgtgtggacacagcccaaggcttcccttccacgcggtgggaggccgaggagtgagaaagcggaattccgctgtgcaggggagctgaccgatgcaccccggggggacgccggccaagtgaatggggtcactccaaggccagggactctccacatcttccatggtgtgacctggatccccacacatgtggtgtcaatcaaaacattgctctagcccggggtgttactcccttcctggcccctgcgctttgtgtgcttgggccgcatgccccgcctccccactccacgaagtgtgagacagcaagacatgaacttgcttgatacctggtccccctgacacgcagctggagcacgcagcatccccacgtgtccagagactgcg

SEQ ID NO: 141421 - DNA, 486 bp, Homo sapiens
  Payload ID: 7799
  Gene Symbol: HUNK
  Gene Name: hormonally up-regulated Neu-associated kinase
  ENST ID: ENST00000430354
  CDS Start-End: 1-486
cagatgatccgccaccccaatatcactcagctccttgatattttagaaacggaaaacagctactacctggtcatggagctgtgccctgggggcaacctgatgcacaagatctatgagaagaagcggctggaggagtccgaagcccgcagatacatccgacagctcatctctgccgtagagcacctgcaccgggccggggtggtccacagagacttgaagatagagaatttgctactagatgaagacaataatatcaagctgattgactttggtttgagcaactgcgcagggatcctgggttactcggatccgttcagcacacagtgtggcagccctgcctacgctgcacctgaactgctcgccaggaagaaatacggccccaaaatcgatgtctggtccatgtgccatcagtttcctgcgctctctcctggaaccggatcctgtgaagaggccaaatattcagcaggcactggcgaatcgctggct

SEQ ID NO: 141422 - DNA, 9623 bp, Homo sapiens
  Payload ID: 7800
  Gene Symbol: HRNR
  Gene Name: hornerin
  Uniprot ID: Q86YZ3
  ENST ID: ENST00000368801
  CDS Start-End: 77-8629
accctgaaagctgtttctgtctctaccctacttgttcctctggtgagctaggttactcaaacttgcaaaaaaaaaaatgcctaaactcctacaaggcgtcatcactgtcatcgatgttttctaccaatatgccacccagcatggggagtatgatacgttgaacaaggcagagctgaaagaacttctggaaaatgagtttcatcaaattctgaagaatccaaacgatccagatactgtggatatcatcttgcaaagtctggatcgagaccataacaagaaagtggattttactgagtatcttctgatgatattcaagctggttcaggctcgtaataaaatcattggcaaagattactgccaagtttcagggtcaaagctgagagatgacactcaccagcaccaagaggaacaagaagaaactgaaaaagaggagaacaaacggcaagaatcctcttttagtcattcaagttggagtgcaggagagaatgattcctattccagaaacgtcagaggaagtcttaaacctgggactgaatccatatccagaagactgagttttcaaagagacttttctggccaacataactcctactcaggtcagtcttccagctatggtgagcaaaactccgactcccatcagtcttcaggccgcggccaatgtgggtctgggtcagggcagtctcccaactatggccaacacggctctggctccggacagtcttccagcaatgacacacatgggtctggctcaggccagtcttctggctttagtcaacacaagtctagctcagggcagtcctctggttacagtcagcatggatctggctcaggtcactcctctggctacggacaacacggctctaggtcaggacagtcatctaggggtgaacgacacagatctagctcaggttcgtcttccagctatggtcagcatgggtctggttcccgtcagtctttgggccacggccgacaagggtctggatctcgccagtctcctagccacgtccgacatgggtccggttcggggcactcctccagccacggccaacacgggtctggctcaagttactcttacagccgtggccattatgagtctggctcaggccagacttctggctttgggcaacatgagtctggctcaggacagtcctctggctatagtaagcatggttctggctcaggtcactcctctagccagggacaacatggatctacgtcagggcaggcatcaagctctggccaacatggctccagctcacgtcagtcttccagctatggtcagcatgagtctgcctcccgtcactcttcaggccgcggccaacacagctctggatctggccagtctccaggccacggccagcgtgggtctgggtcagggcagtctcccagctccggccaacatgggactggctttggtcgatcttccagcagtggcccatatgtgtctggttcaggctactcttctggctttggtcaccacgagtctagctcagagcattcctctggttacactcagcatggatctggctcaggtcactcctccggccacggacaacacggctctaggtcaggacagtcatctaggggtgaacgacaaggatctagtgcaggttcatcttccagctatggtcagcatgggtctggctcccgtcaatctttgggacacagccgacatgggtctggatctggccagtctcctagccctagccgtggccgacatgagtctggttccaggcagtcttccagctatggcccacatgggtatggctcagggaggtcttcaagccgtggcccatatgagtctggctccggtcactcttctggcttaggtcaccaagagtctcgctcaggacagtcctctggctacggtcaacacggatctagctcgggtcattcctctacccatgggcaacatggttctacatcaggacagtcatcgagctgtggccaacatggagctacctcaggtcagtcttccagccacggtcagcatggctctggctcaagtcagtcttctcgctatggccaacagggctctggatctggccagtctcctagtcgcggccgacatgggtccgattttgggcactcttccagctacggccaacatgggtctggctccggttggtcttcaagcaatggcccacatgggtctgtctcaggccagtcttccggctttggtcacaagtctggctcagggcagtcctctggttacagtcagcatggatctggctcaagtcactcctccggctacagaaaacacggctctaggtcaggacagtcatctaggagtgaacaacacggatctagctcaggtttgtcttccagctatggtcagcatgggtcgggctcccatcaatcttcgggccacggccgacaagggtctggatctggccactctcctagccgtgtccgacatgggtccagttcagggcactcctccagccacggccaacacgggtctggcacaagttgttcttccagctgtggccattatgagtctggctcaggccaggcttctggttttgggcaacacgagtctggctcaggacagggctatagtcagcatggttctgcctcaggtcacttctctagccagggacgacatggatctacgtcagggcagtcatcaagctccggccaacatgactctagctcaggtcaatcttccagctatggtcagcatgagtctgcctcccatcacgcttcgggccgcggccgacatggctctggatctggccagtctccaggccacggccagcgtgggtctgggtcagggcagtctcccagctatggccgacatgggtctggctccggtcggtcttccagcagtggccgacatgggtctggctcaggccagtcttctggctttggtcacaagtctagctcagggcagtcctctggttacactcagcatggatctggctcaggtcactcctccagctacgaacaacacggctctaggtcaggacagtcatctaggagcgaacaacatggatctagctcaggttcgtcttccagctatggtcagcatgggtctggctcccgtcagtctttgggccacggccaacatgggtctggatctggccagtctcctagccctagccgtggccgacatgggtctggttccgggcagtcttccagctatggcccatataggtctggctcagggtggtcttcaagccgtggcccatatgagtctggctccggtcactcttctggcttaggtcaccgagagtctcgctcaggacagtcctctggctacggtcaacatggatctagctcaggtcattcctctacccatgggcaacacggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccattcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcctagtcgcggccgacatgggtccggttctgggcactcttccagctacggccaacatgggtctggctccggttggtcttccagcagtggccgacatgggtctggctcaggtcagtcttctggatttggtcaccacgagtctagctcatggcagtcctctggttgcactcagcatggatctggctcaggtcactcctccagctacgaacaacacggctctaggtcaggacagtcatctaggggtgaacgacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacagcccatatgggtctggctcagggtggtcttccagccgtggcccatatgagtctggctccagtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcacgttcgtcttcccgctatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttccgggcactcttccagctacggccaacatgggtctggctccggttggtcttccagcagtggccgacatgggtctggctcaggtcagtcttctggatttggtcaccatgagtctagctcatggcagtcctctggttacactcagcatggatctggctcaggtcactcctccagctacgaacaacacggctctaggtcaggacagtcatctaggggtgaacaacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacggcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctgcatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctatggccgacatgggtctggctccggtcggtcttccagcagtggccaacatgggcctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccgctatggtcagcatgggtctggctcccgtcagtcttcgggccacggccgacaagggtctggatctggccattcccctagccgcggccgacatgggtccggttcggggcactcctccagccacggccaacatgggtctggctcaggtcgttcttccagccgtggcccatatgagtctcgctcgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggtcagtcttccagccacggtcagcatggctctggctcaagtcagtcttctagctatggccaacagggctctggatctggccagtctcctagtcgcggccgacatgggtccggttccgggcactcttccagctacggccaacatgggtctggctccggttggtcttccagcagtggccgacatgggtctggctcaggtcagtcttctggatttggtcaccacgagtctagctcatggcagtcctctggttacactcagcatggatctggctcaggtcactcctccagctacgaacaacacggctctaggtcaggacagtcatctaggggtgaacgacacggatctagctcaggttcatcttccagctatggtcagcatgggtctggctcccgtcagtctttgggccacggccaacatgggtctggatctggccagtctcctagccctagccgtggccgacatgggtctggttctgggcagtcttccagctacagcccatatgggtctggctcagggtggtcttccagccgtggcccatatgagtctggctccggtcactcttctggcttaggtcaccgagagtctcgctcaggacagtcctctggctacggtcaacatggatctagctcaggtcattcctctacccatgggcaacatggttctacatcaggacagtcatcgagctgtggccaacatggagctagctcaggtcagtcttccagccacggtcagcatggctctggctcaagtcagtcttctggctatggccgacagggctctggatctggccagtctccaggccacggccagcgtgggtctgggtcaaggcagtctcccagctacggccgacatgggtctggctccggtcggtcttccagcagtggccaacatgggtctggcttaggcgagtcttctggctttggtcaccacgagtctagctcagggcagtcctctagttacagtcagcatgggtctggctcaggtcactcctctggctacggacaacacggctctagatcaggacagtcatctaggggtgaacgacacggatctagctcaggttcgtcttcccactatggtcagcatgggtctggctcccgtcagtcttcgggccacggccgacaagggtctggatctggccagtcccctagccgcggccgacatgggtccggtttggggcactcctccagccacggccaacatgggtctggctcaggtcgttcttccagccgtggcccatatgagtctcgcttgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcttagccacggccgacacgggtctggttcagggcagtcttccagctacggccaacatgggtctggctcaggacagtcctctggttatagtcagcatggaagtggctcagggcaagatgggtattcttattgcaaaggaggaagtaaccatgatgggggaagttctggctcatattttctcagttttcctagtagcacttcaccctatgaatatgtccaagagcagaggtgctacttttatcagtgaataataaacataaatgcaatttactcaagtagcaatttaagaaataggaaagtcatctatgaattcatcatgaaagacaagcaatccatcatgaaattcgttctaaaagtgaatcaatgcatttctgtctctttctttagagcctaaaactgtagcatatatcttgttatggggttccttccaaagactgttaggcatttgtgctactttgttagaaaatactgagtggaataacttgttagaatgagggttaaactttgaggaataatgaaaagcttttaaagagctttgggtttagttggagttgtctttttgagagctcatcattcatttatagatggtgccaaagctaaccttacatttcttagaagcaaaatattacaaatgcattaccagtcctagatacaaagctttgttttacagcaattagtgtaccctaatttttagtgtgccccaagtttggtgtgtcccaatttttggtattgtggcagaaggtgaaggctctgaaagcaaagatgcagcagcggtagtgtctttacttatcaaaaccatcaagtcctttttcttgggtatatatttaatcagtaagttaattagtggcataaaaaagtagcatcagggtcttttcccaagccagtgagcaagagcattatttcataaagaatagggatttatcatttcaggaaaaaaaaaaacattcaaatgtgggctttagcttgttttcagcagaaagatcttgctccctatttctaagaggctgctcaatattgggaaatatattgaggagttattccatggaaatacaatgctttccacctactactgtagttcaataacgtttccacctgaaaaaatatcatccatgcccagatgaaaaggaagagtatctgtcactgctacatagttccttaatttgactgtaacacatttgtttcaagtctttggattcaaacaaccggattgtattaaaattgacaataaataaatgttgatt

SEQ ID NO: 141423 - DNA, 8869 bp, Homo sapiens
  Payload ID: 7801
  Gene Symbol: HCFC1
  Gene Name: host cell factor C1
  Uniprot ID: P51610
  ENST ID: ENST00000310441
  CDS Start-End: 968-7075
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccac

SEQ ID NO: 141424 - DNA, 8375 bp, Homo sapiens
  Payload ID: 7801
  Gene Symbol: HCFC1
  Gene Name: host cell factor C1
  ENST ID: ENST00000369984
  CDS Start-End: 345-6587
aggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatggcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaat

SEQ ID NO: 141425 - DNA, 3624 bp, Homo sapiens
  Payload ID: 7801
  Gene Symbol: HCFC1
  Gene Name: host cell factor C1
  ENST ID: ENST00000444191
  CDS Start-End: 1-1834
gacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatggcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataa

SEQ ID NO: 141426 - DNA, 965 bp, Homo sapiens
  Payload ID: 7802
  Gene Symbol: HCFC1R1
  Gene Name: host cell factor C1 regulator 1 (XPO1 dependent)
  Uniprot ID: Q9NWW0
  ENST ID: ENST00000248089
  CDS Start-End: 306-722
gtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaaggctt

SEQ ID NO: 141427 - DNA, 765 bp, Homo sapiens
  Payload ID: 7802
  Gene Symbol: HCFC1R1
  Gene Name: host cell factor C1 regulator 1 (XPO1 dependent)
  ENST ID: ENST00000354679
  CDS Start-End: 333-743
cttacgtgcctagagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccaggctgcctcctgtgtcagtatcccagcctgcctctctgccatctctccccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctc

SEQ ID NO: 141428 - DNA, 495 bp, Homo sapiens
  Payload ID: 7802
  Gene Symbol: HCFC1R1
  Gene Name: host cell factor C1 regulator 1 (XPO1 dependent)
  ENST ID: ENST00000573842
  CDS Start-End: 134-495
aacctcacgaggccttacgtgcctagagcggttcctctccgtggcgccctaccgccttcggcgcgaaggtggctggtgcgtaccgtcccgaaccctaggagccgagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctggggga

SEQ ID NO: 141429 - DNA, 610 bp, Homo sapiens
  Payload ID: 7802
  Gene Symbol: HCFC1R1
  Gene Name: host cell factor C1 regulator 1 (XPO1 dependent)
  ENST ID: ENST00000572355
  CDS Start-End: 80-376
cgccttcggcgcgaaggtggctggtgcgtaccgtcccgaaccctaggagccgagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaa

SEQ ID NO: 141430 - DNA, 618 bp, Homo sapiens
  Payload ID: 7802
  Gene Symbol: HCFC1R1
  Gene Name: host cell factor C1 regulator 1 (XPO1 dependent)
  Uniprot ID: Q9NWW0
  ENST ID: ENST00000574151
  CDS Start-End: 21-380
ccgcaggaccccaaaacccaatgatcctgcagcagcccttgcagcgaggcccccagggaggggcccagcgcctcccgcgggccgccttgggggtgacttggggcctggacgccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaa

SEQ ID NO: 141431 - DNA, 845 bp, Homo sapiens
  Payload ID: 7802
  Gene Symbol: HCFC1R1
  Gene Name: host cell factor C1 regulator 1 (XPO1 dependent)
  Uniprot ID: Q9NWW0
  ENST ID: ENST00000574980
  CDS Start-End: 242-658
gagcggttcctctccgtggcgccctaccgccttcggcgcgaaggtggctgcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagg

SEQ ID NO: 141432 - DNA, 5734 bp, Homo sapiens
  Payload ID: 7803
  Gene Symbol: HCFC2
  Gene Name: host cell factor C2
  Uniprot ID: Q9Y5Z7
  ENST ID: ENST00000229330
  CDS Start-End: 105-2483
cacgtgaccccagcacagctggaggcgggtccccgccctccccagggagcagccggttgaggcgggagcggtgcattgtgggcagaggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaaggagtcaggatggaccctcacagacaaggcagtaataacatcgttcctaacagtatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaattagtatatgagttcttccttacagatatagctcttttataaagaaaaacagtgaaattaagataaaagctagaaagctttattaccccaatatcttttataagggctgtgtaacccagtcatcctagagttattgagatgattctggtaactggctgttgtatactatgctgtcttatatagtaaatgttctctacattgtaaatgtcctacctttgagtactccttctatctttattctatatgagcagtgttcctctaacaactgtcttctattggataatatgtgtgatactataataattctaatagttatttgattcctttctttgtttacagttagcacagagcttaagaaattaaaaaagaggcaagtttagaaactgcttttgaacttttattattttccaagaatcatggtaaaatacaacaagaacaatgagttttcttgattcttaccaggccaatatatttgaatatatttttggccaaagcacttaacttatctggccctcattttcctcataacagatgagggagttaaagcagtttatcttttaggtccctttcagcactaaggttttgtgtttttagtagaagtgaagtatgtccctgaacattttcatctgtcttaatggctctaattttgcttttgctaaaattaaaatcttcataattgaattcaaaattaaagtatatgtcctcctattggagaaaaaaacaagcaccttaacaggacacaagttttaaaatagtgttttaaacatttgtaagatttttgtaaatgctctaaatgttttatttttgcattgtttttaccttgaaattgtataaacttttttactatgaaaatataagcattagacagctaactcaggttccattacaaccttaaagatacagataggcattataaacactctgctacaggtaacttgttttaaaccttttaggaatttcatggttccactgcctatttaaatctggaattaatatacagagcaataattgcagaaaagatatttcaaactaagagcttcaataactgcaggggcacaggtctatctttttttataccacataaccttatgccagtttaggttgactgagtagctatgtcctcaaatttcatgtatgataccccccagcaaagatggatttaattgtgcagaattgatatatatgtgtgttccagttactaatttaaagtgtatagaatattttaatatataatttttgtaaagaactgggatttttatactacagtatttgtaattaatgtgtctcactaattaagtttctcttgaagaaaatatgcaaattgttagacacataatgagtggtttccaaactctaaagataaaataaatgcactactatggtgttgttagaataccttttttgtggctgtatgaatctttactctttaaatgtgtactttacaatgtttacaaggagcttctctggtttgttatcccagcaatgcccttggtgagagcttcattctgcatttgtttaattcatatgctttgcttttggcatatgcttgctttttgcactagtagaattttaacttacctcattattatgtttgtaatcatttgtctagcttctgtaatgtatctgatataggctaaacaaatacttaaccaaagttaaaatacatggtaagcaattttgcacatattaaatattagggtttgttgtgtatatgtgtatacttaattataaaagaatatgaatggaaagttatactaaaagtatatgtttcaagcccagttattttaaagatctattgctttaatagaaaaagtttggcttttaaccctttcttctctgcattaattaacaacgtgcatcttgaagcccttctcctgataacaaggaataagttgattttaagcaaaggatagaatatttgtttgagtgtgcacatttatacctgtttagtatttgattcagttaagcctccactcttctggatcaggaggtgattctgaacctgtggttctaacatatgacttaactgtttagagggaagagaagtctttctatactgagggatttgttaaaatcataaatgtttttgccctgagacttagcccagattctattttttttttttttttggcatttgtacattaagcaccagtcatatttatctctgtgataagggattgctgactaaaaaatgccattaagaaatctctgtggctttgacattagtagttaataagagatcttagagctgtgtgctgatgaatagaatgaattggagcaaatagcaagagaagtgcatttagcttcttatgatttgcacattttctaaatgaagatccctttgtgtagcagtaggctgtatcatgcagatatttttcataggatttgcactgagttaaatgactttctttactcttcccagtcaggtaagcagttcaaatataacaagactttgtgccagtcctcttctgtgttctgcaactctggctctcataagtagtaaaaatatttttgatgttgcatgctctcagaattatgttttctaaaatatcatattggcttcattttagtttaataaacttctttggcaacttaattagacatagggtatatataaactcaattttatctgcattttttaaaaaattgaaataatctgattgcatgtatgaaggactcctgcctcattacccaattacataaatacaattatctataggaaggtgaaattgttgatctattatttcaaagacttgtagactagcaaagattcattctgattagaaataaggtctatagctaaagatatttttattttaaaaaattacagcccttgtaacaaaaatcatttgtaacattggatatgaagacattattagtatttaaaattattgtagtcatttgatcataaatgaagtagcttgcaaaatagacttggtctttgaccctttaaggtgtaactgactgactgttgtgtttttcaagactgattttaggcagttttatgtatcgtgtaccaatgatatgtaaaataaagcaccttttctactataaacaa

SEQ ID NO: 141433 - DNA, 2538 bp, Homo sapiens
  Payload ID: 7803
  Gene Symbol: HCFC2
  Gene Name: host cell factor C2
  Uniprot ID: Q9Y5Z7
  ENST ID: ENST00000544223
  CDS Start-End: 20-1258
aggggcgggggttgggaagatggcggctcccagcctcctcaactggaggcgagtttcttccttcacggggccggtcccccgcgcccggcacggacaccgagcggtggccatccgggagctgatgatcatctttggagggggaaatgagggcatcgcggatgagctgcacgtctacaacacggctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagctacagcatggctctggtgttgtgggttggagcattccagtgactaaaggggttgtgccttctccaagagaatcccacacagctgttatatattgcaaaaaagattctggaagtcctaaaatgtatgtttttggtggaatgtgtggtgctcgcctggatgacctatggcagcttgacttagaaactatgtcatggtcaaaaccagaaactaaagggacagtgccacttccacgaagccttcatacagccagtgttataggaaacaagatgtacatttttggtggatgggtcccacataagggggaaaatactgagacttcacctcatgattgtgaatggagatgtaccagttcattttcttacctaaatctggatacaacagagtggaccaccctagtatcagattctcaggaagataaaaaaaattcaagaccaagaccaagagctggccactgtgctgttgcaatcggcactcgattgtatttttggagtggaagagatggctacaaaaaagcactgaatagtcaagtttgctgcaaggatctttggtatcttgatactgagaaaccaccggcaccatctcaagtacagctgatcaaagccactaccaactcctttcatgtcaagtgggatgaagtgtctacagttgagggctatcttttgcagttgagtacagacttgccataccaagctgcatcatcagattcttcagcagcaccaaatatgcaagatcaatgatacaataaacagcacaaaaactgaacagccagccacaaaagaaacttcaatgaaaaacaaaccagactttaaagcactgacggattctaatgccattttatatccatctttggcatcaaatgcttctaatcataatagtcatgtggtggatatgctaaggaaaaatgaaggtcctcacacttcagcaaatgtaggtgttctaagtagttgcctggatgtaagaacagtaattcctgaaacatctgtatccagtactgtttccagcacacaaactatggtaacccagcagaccattaaaactgaatcatccagtacaaatggggcagttgttaaagatgaaacttcactaacaacattcagtaccaaatctgaagttgatgaaacatatgcactgcctgcaacgaagatcagccgtgtagagacacatgctacagcaacgccgttttctaaagagactccttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacttggctatccgcacagcacagatacaagataatccaagtcaacttgtgttcatgaggatttattgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaagactctctgaaaa

SEQ ID NO: 141434 - DNA, 746 bp, Homo sapiens
  Payload ID: 7803
  Gene Symbol: HCFC2
  Gene Name: host cell factor C2
  ENST ID: ENST00000550444
  CDS Start-End: 512-746
accgcccggtcactgcttccttgggcgggcggcggggagcgcggctcagccgggcagcccgggtccggcagctctgtcccggaccgcagctcaggatctccggggcccttggggcgcaacggaccccgagcggggcgcaccggccttcaggcgggggatcccggacgcccccaccccagcccgacaggcggacgcaggcgacagaagaccatgtccaaccgcctgggccactccccgaaatctcgcctctgtcaaaaaacaaaacccactccaaaccaaagttccttagggcctttcccgtctttgcctgccttccttccttaggaggaagaccatctagggggtgaggagggaaaacgagaggccttctggcactctcgcctcaaatacaacccggtgtttggcagctacgaatcagtggtttctgccagctgttagaggagatatccctccaggctgtgctgcccatggatttgtctgtgatggtaccagaatattagtatttgggggaatggttgaatatggaagatacagcaatgagttatatgagttacaagcaagtcgttggttatggaaaaaagtgaaaccccatccccctccttctggtttacctccttgtcctcggcttggacatagcttctctttatatggtaacaaatgctatttgtttggtggcctggcaaacgaaagcgaagattcaaacaataatgttcccagatatttaaatgatttttatgagttggagc

SEQ ID NO: 141435 - DNA, 765 bp, Homo sapiens
  Payload ID: 7804
  Gene Symbol:
  Gene Name: HOXA10-HOXA9
  ENST ID: ENST00000470747
  CDS Start-End: 359-697
gcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtccccctt

SEQ ID NO: 141436 - DNA, 1066 bp, Homo sapiens
  Payload ID: 7805
  Gene Symbol: HRASLS
  Gene Name: HRAS-like suppressor
  ENST ID: ENST00000264735
  CDS Start-End: 95-916
cgggcgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgggaccgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctta

SEQ ID NO: 141437 - DNA, 498 bp, Homo sapiens
  Payload ID: 7805
  Gene Symbol: HRASLS
  Gene Name: HRAS-like suppressor
  ENST ID: ENST00000416012
  CDS Start-End: 1-336
tctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtggagacagtcttaatcaagttgtgaaatacagcaaattgtaaagggttgtttggattaaagggttgtttggaaaagctgggtcagattctagcagagaacc

SEQ ID NO: 141438 - DNA, 742 bp, Homo sapiens
  Payload ID: 7806
  Gene Symbol: HRASLS2
  Gene Name: HRAS-like suppressor 2
  Uniprot ID: Q9NWW9
  ENST ID: ENST00000255695
  CDS Start-End: 60-548
agctaatttaaggctggacacagagtcagcaacacacaagacatcatcttgaaggaaggatggctttggccagaccaagaccgagacttggagacctgattgagatttctcgctttggctatgcacactgggccatctacgtgggagatggctatgtggtccatctggctccggcaagtgaaattgctggagctggtgcggccagtgtcctgtctgccctgaccaacaaagccatagtgaagaaggaactgctgtctgtggtggctgggggagacaactacagggtcaataacaagcacgatgacagatacacaccactgccttccaacaaaatcgtcaagcgggcagaggagttggtggggcaggagttgccttattcgctgaccagtgacaactgcgagcacttcgtgaaccatctgcgctatggcgtctcccgcagtgaccaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcacaggaaaatgtatttggaaatgcagcttagtatgaattctattaaagacacaattgggctctgc

SEQ ID NO: 141439 - DNA, 1166 bp, Homo sapiens
  Payload ID: 7807
  Gene Symbol: HRASLS5
  Gene Name: HRAS-like suppressor family, member 5
  Uniprot ID: Q96KN8
  ENST ID: ENST00000301790
  CDS Start-End: 161-1000
tttgcagcccgcggcgctttcccctccgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacga

SEQ ID NO: 141440 - DNA, 571 bp, Homo sapiens
  Payload ID: 7807
  Gene Symbol: HRASLS5
  Gene Name: HRAS-like suppressor family, member 5
  ENST ID: ENST00000394615
  CDS Start-End: 1-114
aaacccgcctcgcgaaccgccagtaccgggcccaaggaccagccgcctgcgctcagacgttcagctgtgccccactcagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaa

SEQ ID NO: 141441 - DNA, 1167 bp, Homo sapiens
  Payload ID: 7807
  Gene Symbol: HRASLS5
  Gene Name: HRAS-like suppressor family, member 5
  Uniprot ID: Q96KN8
  ENST ID: ENST00000539221
  CDS Start-End: 135-896
cgcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggatctggtatctagtgtgtatctcttatgcgccaggcactgtgcta

SEQ ID NO: 141442 - DNA, 2599 bp, Homo sapiens
  Payload ID: 7807
  Gene Symbol: HRASLS5
  Gene Name: HRAS-like suppressor family, member 5
  ENST ID: ENST00000536887
  CDS Start-End: 1-148
cgggcccaaggaccagccgcctgcgctcagacgttcagctgtgccccactcagaagaatccgtgggattcgcagcgttggtccagctcccagccaagcagcctccgccgggcacattagaacagggcagaagcatccagcaagggtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggatctggtatctagtgtgtatctcttatgcgccaggcactgtgctaggcatttcatatacggatctaatttcactctctttgtaggatgggaccttgcttgtgtcttaggctgaccttggtctccgatgcttgagtgccatcagaaacatcccagaaacctctgcttgaatatttccagtaacgaagatgtctttttccagatgttctttttatttaactaaaatgtctctagcttctttccatttatgataatcctgcccttttcgacccacagtgtagctcagaggaggaggaccttaagaaaaactgagattcgttattcagggcccatggtaccttaatctagaaacacatatcccaagaaatattttctttttaaaattatacatcaactttatgccttattgtttaaaaatcttctatcaaaagtatcatcgataagacaatttatcttgcttttgtacctcataattaccctaaaatgtgaagtttctagtctcactgatttcagatgaatatttaaaataatttgataagtttaatcaattgaactctactgtgtgagtgagggagagaaaggagttatttttgtgttttgaagaaagttgacaggatggaagatctgaaattatggctggggattgtagtgatagctggtagctgaaaccacccaaaaaagctagaaaagtgttctcttatgcctccagagatacctagaaaatatgaagaatgtggaaaagagcaagatggaaccctcagagtgtttcagataaggtctgttggtatctccataagcttttctcctatttggagaaaatagactctcactgaaactcttcaatgtttttaccctccatccttttcttagcaatctaaactcaatggcctcctgttccccaacactgcagtctgggcatctgactttgtcttccctctgcactcatttctgtgaatcatgaccaggatgaaactgatatccctagttcctcttccccatttcttctcacactcccctgcctgagaatcagttgagttcccaatacctcttccttcagtctctattcattatatggtctaggttgagacttccttggaagcagaacctgagtaccaggaactcatattttataaagtatatttattccttttagctgcaaactaacccagccatgttttagtgaatgctttaatctgaagatgactttgagctcattgaccatattaatctttcatcaaacaaactggatgttgtttcattaacaaaaaactcctccacaccaaggagtgtttagtaacttctgcacagaggactcatccatctcttgcttatgtttgggacagaaagacacttctctggctttttactggcttgaacccaatgggacagagactctctagaaagtttcagggctcacattcacttgtttgtccaaaaaatatttttgagtgtctcccaagtgccaaaccctggctactcccacctttgcctgagcccatgagcggtagtctgggggctggatgtgaggagttctgagttggctaggaagacacaaggcacaatggacatggggcaaagtccacttgctggacattggtcccttccacttccaagctgtccatcaggctgagagatctggaatgcataccccacactttgaagatgaggaagggcgagtttctcaaagtgtgtgtgtgtgtttctcttttaatctgtaatggtttctgcattttgaggtagaaacagaaatctcttttttgagtgggaccactcgggtgcggcttcttagtcttgttgatataataaagcacatgcccactcctcatggagtggagaggagaaaattctaagggaacgtactctgaatgcaaatgtttctgagattaaacactagtcacttgtt

SEQ ID NO: 141443 - DNA, 3032 bp, Homo sapiens
  Payload ID: 7807
  Gene Symbol: HRASLS5
  Gene Name: HRAS-like suppressor family, member 5
  Uniprot ID: Q96KN8
  ENST ID: ENST00000540857
  CDS Start-End: 134-943
gcggttcctccccgagccgcccccagtgcccaagcttccgcggctccgccgaccaggggccgcgccgactgggaactcgccaggggcgtagtcccctgcaaggcctgggggccggcgaggccgcagaggcgggatgggcctgagcccgggcgccgagggggagtacgcgctccgcctccctaggattcccccacccctccccaaacccgcctcgcgaaccgccagtaccgggcccaaggaccagccgcctgcgctcagacgttcagctgtgccccactcagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtcaatggcctcagatatggcgtaccccggagccagcaggtagagcacgccctgatggaaggagcgaaggctgctggagcagttatttcagctgtagtggatagcataaagcccaaaccaataactgcctgaaggtgatgaaaactccagctagaggaagagttactgacacaagcaaaaagaacatgcttccttcccttgccttctctcaatggctccgattaagaaaattgtgaacttctggaagaatctacaatgtatccaattacccttccagaaatacatccaatatatacgagcatagacccacagactctcaggatgggaaggatctggtatctagtgtgtatctcttatgcgccaggcactgtgctaggcatttcatatacggatctaatttcactctctttgtaggatgggaccttgcttgtgtcttaggctgaccttggtctccgatgcttgagtgccatcagaaacatcccagaaacctctgcttgaatatttccagtaacgaagatgtctttttccagatgttctttttatttaactaaaatgtctctagcttctttccatttatgataatcctgcccttttcgacccacagtgtagctcagaggaggaggaccttaagaaaaactgagattcgttattcagggcccatggtaccttaatctagaaacacatatcccaagaaatattttctttttaaaattatacatcaactttatgccttattgtttaaaaatcttctatcaaaagtatcatcgataagacaatttatcttgcttttgtacctcataattaccctaaaatgtgaagtttctagtctcactgatttcagatgaatatttaaaataatttgataagtttaatcaattgaactctactgtgtgagtgagggagagaaaggagttatttttgtgttttgaagaaagttgacaggatggaagatctgaaattatggctggggattgtagtgatagctggtagctgaaaccacccaaaaaagctagaaaagtgttctcttatgcctccagagatacctagaaaatatgaagaatgtggaaaagagcaagatggaaccctcagagtgtttcagataaggtctgttggtatctccataagcttttctcctatttggagaaaatagactctcactgaaactcttcaatgtttttaccctccatccttttcttagcaatctaaactcaatggcctcctgttccccaacactgcagtctgggcatctgactttgtcttccctctgcactcatttctgtgaatcatgaccaggatgaaactgatatccctagttcctcttccccatttcttctcacactcccctgcctgagaatcagttgagttcccaatacctcttccttcagtctctattcattatatggtctaggttgagacttccttggaagcagaacctgagtaccaggaactcatattttataaagtatatttattccttttagctgcaaactaacccagccatgttttagtgaatgctttaatctgaagatgactttgagctcattgaccatattaatctttcatcaaacaaactggatgttgtttcattaacaaaaaactcctccacaccaaggagtgtttagtaacttctgcacagaggactcatccatctcttgcttatgtttgggacagaaagacacttctctggctttttactggcttgaacccaatgggacagagactctctagaaagtttcagggctcacattcacttgtttgtccaaaaaatatttttgagtgtctcccaagtgccaaaccctggctactcccacctttgcctgagcccatgagcggtagtctgggggctggatgtgaggagttctgagttggctaggaagacacaaggcacaatggacatggggcaaagtccacttgctggacattggtcccttccacttccaagctgtccatcaggctgagagatctggaatgcataccccacactttgaagatgaggaagggcgagtttctcaaagtgtgtgtgtgtgtttctcttttaatctgtaatggtttctgcattttgaggtagaaacagaaatctcttttttgagtgggaccactcgggtgcggcttcttagtcttgttgatataataaagcacatgcccactcctcatggagtggagaggagaaaattctaagggaacgtactctgaatgcaaatgtttctgagattaaacacta

SEQ ID NO: 141444 - DNA, 732 bp, Homo sapiens
  Payload ID: 7807
  Gene Symbol: HRASLS5
  Gene Name: HRAS-like suppressor family, member 5
  ENST ID: ENST00000538712
  CDS Start-End: 676-732
tctctttggcagaggaactgaacccgctccagcacctagttccacaaccctctccattcatcccaagattttctgaggcctaaccaggggccaggcacgatgctagactagagctctgagcccactctccgtagcggtcaaggtgcttgctcgaactctcctttcacaggtctaaatagcatttccccccttgaattagaagaatccgtgggattcgcagcgttggtccagctcccagccaagcagcctccgccgggcacattagaacagggcagaagcatccagcaaggggagaaggctgtagttagcttggagaccacacccagccagaaagcagactggagttcaattccaaagcctgagaatgaaggcaagttaataaagcaagcagctgagggaaaaccaagacccagacctggagacctgattgagatttttcgaattggctatgagcactgggccatctatgtagaagatgattgcgtggtccatctggctcccccaagtgaggagtttgaggtgggcagcattacttccatctttagcaatcgggccgtggtgaaatacagtcgtctggaggatgtgctgcatggctgctcctggaaggtcaataacaagctagatgggacgtacctgcccttgccggtggacaagatcatccagcgtacaaaaaagatggtcaacaagatcgtgcagtacagcctgattgaagggaactgtgagcactttgtc

SEQ ID NO: 141445 - DNA, 1114 bp, Homo sapiens
  Payload ID: 7808
  Gene Symbol: HSCB
  Gene Name: HscB mitochondrial iron-sulfur cluster co-chaperone
  Uniprot ID: Q8IWL3
  ENST ID: ENST00000216027
  CDS Start-End: 66-773
gtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaa

SEQ ID NO: 141446 - DNA, 955 bp, Homo sapiens
  Payload ID: 7808
  Gene Symbol: HSCB
  Gene Name: HscB mitochondrial iron-sulfur cluster co-chaperone
  ENST ID: ENST00000398941
  CDS Start-End: 42-473
tttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttgtaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaattctt

SEQ ID NO: 141447 - DNA, 1048 bp, Homo sapiens
  Payload ID: 7808
  Gene Symbol: HSCB
  Gene Name: HscB mitochondrial iron-sulfur cluster co-chaperone
  ENST ID: ENST00000450178
  CDS Start-End: 55-372
cgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacagactgaaaaggacttctcagagaagcattcgaccctggtgaatgatgcctataagaccctcctggcccccctgagcagaggactgtaccttctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggcacagtggctcacacctgtaatcccagcactttgggaggctgaggtgggtggatgacaaggtcaggagttcaagaccagcttggccaacatagtgaaaccccgtctctgctgaaaatacaaaaattagccgggcatggtggcgcgtgcctgtaatcccagctacttggtaggccgaggcaggagaatcgcttaaacccgtgaggtggaggttgcagtgagcagagatcacgcaactgcactccagcttgggcaacagagtgagacttaatcttgaaaaataaataaatgaaaaataaaa

SEQ ID NO: 141448 - DNA, 792 bp, Homo sapiens
  Payload ID: 7808
  Gene Symbol: HSCB
  Gene Name: HscB mitochondrial iron-sulfur cluster co-chaperone
  ENST ID: ENST00000420442
  CDS Start-End: 36-467
cacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactgcaaccgttccttcagagttgatacagcgaagctccagcacaggtaccagcaactgcagcgtcttgtccacccagatttcttcagccagaggtctcagactgaaaaggacttctcagagaagcattcgaccctggtgaatgatgcctataagaccctcctggcccccctgagcagaggactgtaccttgtaagctaaagctccatggaatagagattcctgaaaggacagattatgaaatggacaggcaattcctcatagaaataatggaaatcaatgaaaaactcgcagaagctgaaagtgaagctgccatgaaagagattgaatccattgtcaaagctaaacagaaagaatttactgacaatgtgagcagtgcttttgaacaagatgactttgaagaagccaaggaaattttgacaaagatgagatacttttcaaatatagaagaaaagatcaagttaaagaagattcccctttaattgtggatagtttaaagtttaaaaaataaagttcttgctgggca

SEQ ID NO: 141449 - DNA, 1768 bp, Homo sapiens
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENST ID: ENST00000255631
  CDS Start-End: 312-1391
cgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctcttt

SEQ ID NO: 141450 - DNA, 1572 bp, Homo sapiens
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENST ID: ENST00000433386
  CDS Start-End: 238-1317
aaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctc

SEQ ID NO: 141451 - DNA, 557 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000585698
  CDS Start-End: 145-557
gttgctagggagaaaggagaggcttatgactttggggaagggtcctgtggaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgc

SEQ ID NO: 141452 - DNA, 884 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000593263
  CDS Start-End: 243-884
gactttgtctgtaggagcagcggcggcttgaggacccggggaggtgagatccgccttattccggcgcccctcttcggagaggagggagaagacttgttgctaaggagaccaaagggcgggcttgttgctacggaggcggagcagtgagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgt

SEQ ID NO: 141453 - DNA, 666 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000585927
  CDS Start-End: 97-666
agaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctctgctgcagcagcatgaggagtaccaggaggagctggagttctgtgaaaagctgctacagacctgtttct

SEQ ID NO: 141454 - DNA, 424 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000587959
  CDS Start-End: 133-424
cgacccatcaggacgccagagctgcttcagcggtgaccaccttctccctctaacacattcttcccttcttcacaaacggcccatcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacg

SEQ ID NO: 141455 - DNA, 1449 bp, Homo sapiens
  Payload ID: 7809
  Gene Symbol: HSPBP1
  Gene Name: HSPA (heat shock 70kDa) binding protein, cytoplasmic cochaperone 1
  Uniprot ID: Q9NZL4
  ENST ID: ENST00000587922
  CDS Start-End: 249-1328
gttgctagggagaaaggagaggcttatgactttggggaagggtcctgtgggtatgaaggaaggaaaaggggctgtggttaagtgggctgggggcagagtggtttggggtcatggggggtcgccgagctcccctgaaacgccgccttctcagcagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgcca

SEQ ID NO: 141456 - DNA, 536 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000587551
  CDS Start-End: 442-536
aaaagtatcgggggcgggactcgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctc

SEQ ID NO: 141457 - DNA, 696 bp, Homo sapiens
  Payload ID: 7809
  Gene Symbol: HSPBP1
  Gene Name: HSPA (heat shock 70kDa) binding protein, cytoplasmic cochaperone 1
  ENST ID: ENST00000588971
  CDS Start-End: 287-696
cagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagcagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgc

SEQ ID NO: 141458 - DNA, 1953 bp, Homo sapiens
  Payload ID: 7810
  Gene Symbol: HSPBAP1
  Gene Name: HSPB (heat shock 27kDa) associated protein 1
  Uniprot ID: Q96EW2
  ENST ID: ENST00000306103
  CDS Start-End: 145-1611
ccggcgtttccgtaggagccgggcgggagtcgccggggctccttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaa

SEQ ID NO: 141459 - DNA, 1521 bp, Homo sapiens
  Payload ID: 7811
  Gene Symbol: HSPB2-C11orf52
  Gene Name: HSPB2-C11orf52 readthrough (NMD candidate)
  ENST ID: ENST00000534100
  CDS Start-End: 89-247
gagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggtttctttttattgaagcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgctaggttgaaatctgacactgacacagactccgggagctgccgcggaaagctcaaccaggaacccggaaatgcacaagcctcttgatgcataaaaacagctgggctcccttggagacagagcgccatgggaaaccgggtctgctgcggaggaagctggagctgcccatcaactttccagaagaaaaagaaaacaggaagccaaacaagacggacactgaagccgcagccacaacagctgcagcagaatctcccaaagggccatgaaacaacaggacatacgtatgaacgggtgttacagcagcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaacccagggatgttgtccacgttttaagcttaaagaactccaaagcccctggaattgtgggcgtcccattttctcccctggcctcttacttgccactgttaggttggagttaatagttggtttagctatgggtggatagctaaacttagctatccacatgaggttaggtggagtgtgcagggaggtaggtcttcgaccccaccattgttgctcctgctcttgcaaagtgcagaaagagcaggtaaaaagttagcccataagcacgtgggctgatcttgttggactttaattaatggtatcctttttcacacaccttaaactccaaagctgaaggggaggtgctccggaaaagcattctgagcttttacattcagacactagggctggcttgggccatttcctcagtggctgagtcaggttccagaccttaacagacaaatgggggaagggggctgaggcgtggaggaaacgctttcaggacctcaagtcagtgataaccgacagcacagtgaggcctggaaacttccctcggagggactgttggctctcgcaggtgcggggccgctaggatcaataaacggcctgagaaaca

SEQ ID NO: 141460 - DNA, 892 bp, Homo sapiens
  Payload ID: 7811
  Gene Symbol: HSPB2-C11orf52
  Gene Name: HSPB2-C11orf52 readthrough (NMD candidate)
  ENST ID: ENST00000527616
  CDS Start-End: 95-643
cctatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtttctttttattgaagcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgcta

SEQ ID NO: 141461 - DNA, 890 bp, Homo sapiens
  Payload ID: 7812
  Gene Symbol: HSPE1-MOB4
  Gene Name: HSPE1-MOB4 readthrough
  ENST ID: ENST00000604458
  CDS Start-End: 25-810
tacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgt

SEQ ID NO: 141462 - DNA, 2120 bp, Homo sapiens
  Payload ID: 7813
  Gene Symbol: HTRA1
  Gene Name: HtrA serine peptidase 1
  Uniprot ID: Q92743
  ENST ID: ENST00000368984
  CDS Start-End: 129-1571
caatgggctgggccgcgcggccgcgcgcactcgcacccgctgcccccgaggccctcctgcactctccccggcgccgctctccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattgc

SEQ ID NO: 141463 - DNA, 1214 bp, Homo sapiens
  Payload ID: 7813
  Gene Symbol: HTRA1
  Gene Name: HtrA serine peptidase 1
  ENST ID: ENST00000420892
  CDS Start-End: 1-666
ggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 141464 - DNA, 2370 bp, Homo sapiens
  Payload ID: 7814
  Gene Symbol: HTRA2
  Gene Name: HtrA serine peptidase 2
  Uniprot ID: O43464
  ENST ID: ENST00000258080
  CDS Start-End: 631-2007
tctggcagcgcgcagctgaccaggaagacgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgc

SEQ ID NO: 141465 - DNA, 1450 bp, Homo sapiens
  Payload ID: 7814
  Gene Symbol: HTRA2
  Gene Name: HtrA serine peptidase 2
  Uniprot ID: O43464
  ENST ID: ENST00000352222
  CDS Start-End: 18-1103
cagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggca

SEQ ID NO: 141466 - DNA, 1479 bp, Homo sapiens
  Payload ID: 7814
  Gene Symbol: HTRA2
  Gene Name: HtrA serine peptidase 2
  ENST ID: ENST00000437202
  CDS Start-End: 1-1272
cttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggctagggaactgggggctgtatccctgcaggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaa

SEQ ID NO: 141467 - DNA, 2541 bp, Homo sapiens
  Payload ID: 7815
  Gene Symbol: HTRA3
  Gene Name: HtrA serine peptidase 3
  Uniprot ID: P83110
  ENST ID: ENST00000307358
  CDS Start-End: 205-1566
gggagctggtccctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgcccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagcttctcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacacggttctcagcca

SEQ ID NO: 141468 - DNA, 2023 bp, Homo sapiens
  Payload ID: 7815
  Gene Symbol: HTRA3
  Gene Name: HtrA serine peptidase 3
  Uniprot ID: P83110
  ENST ID: ENST00000382512
  CDS Start-End: 193-1266
ctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagccccctcactggcagttcattgagagcagggggcttcctcacgtttccccctcctccatgaccccgtcagccaagcacatggaccccagtgcagccaaggctggtgccatgagggctggtcacatgaagagctgctgttgaggatgccgccattgttcttctgtgtccattatgggaagacaatctggagccaggcagagcctgtctttcccaaagaagctgaagtcttcttctcttgaacagtggggaccatctaatctcttgagcccttttcctgttggcttctaggaagctcagagctagattcaggggtgcacccagacctgtcctagcatgctcctttccctaatgaccgagtctttcctgttgaattatcccattctccatgggtgcctttgactttggcctccttactggaaattagcggagctgctgtttgcacacactgagctgtgaggtggctttccttggaagtggatgatagtgtcctcttcccttcttgcctctctctttctcctgagacaggatccccctggggcctaggtttgctcctttgttgtacaggggctgtcccagttagtgctgacctcatcccagaaccccctgggaaatatcccctgtcctcagagctgtgtcccctccccaaggacagtgcagactaactgaggagcctgataaaccttagctgcatggcacacttgcaattttaaaatccttctgaagttgactggtgtttgtacttgcttctcttttttatttaataaaatccaatgatccaaa

SEQ ID NO: 141469 - DNA, 2095 bp, Homo sapiens
  Payload ID: 7816
  Gene Symbol: HTRA4
  Gene Name: HtrA serine peptidase 4
  Uniprot ID: P83105
  ENST ID: ENST00000302495
  CDS Start-End: 101-1531
gcggaggcggcgccgtggccgggagaaagtgtctctcatttaggagggtttgcaggtccagagtaaagtcactgaagagtggaagcgaggaaggaacaggatgattagacctcagctgcggaccgcggggctgggacgatgcctcctgccggggctgctgctgctcctggtgcccgtcctctgggccggggctgaaaagctacatacccagccctcctgccccgcggtctgccagcccacgcgctgccccgcgctgcccacctgcgcgctggggaccacgccggtgttcgacctgtgccgctgttgccgcgtctgccccgcggccgagcgtgaagtctgcggcggggcgcagggccaaccgtgcgccccggggctgcagtgcctccagccgctgcgccccgggttccccagcacctgcggttgcccgacgctgggaggggccgtgtgcggcagcgacaggcgcacctaccccagcatgtgcgcgctccgggccgaaaaccgcgccgcgcgccgcctgggcaaggtcccggccgtgcctgtgcagtgggggaactgcggggatacagggaccagaagcgcaggcccgctcaggaggaattacaacttcatcgccgcggtggtggagaaggtggcgccatcggtggttcacgtgcagctgtggggcaggttacttcacggcagcaggcttgttcctgtgtacagtggctctgggttcatagtgtctgaggacgggctcattattaccaatgcccatgttgtcaggaaccagcagtggattgaggtggtgctccagaatggggcccgttatgaagctgttgtcaaggatattgaccttaaattggatcttgcggtgattaagattgaatcaaatgctgaacttcctgtactgatgctgggaagatcatctgaccttcgggctggagagtttgtggtggctttgggcagcccattttctctgcagaacacagctactgcaggaattgtcagcaccaaacagcgagggggcaaagaactggggatgaaggattcagatatggactacgtccagattgatgccacaattaattatgggaattctggtggtcctctggtgaacttggatggtgatgtgattggcgtcaattcattgagggtgactgatggaatctcctttgcaattccttcagatcgagttaggcagttcttggcagaataccatgagcaccagatgaaaggaaaggcgttttcaaataagaaatatctgggtctgcaaatgctgtccctcactgtgccccttagtgaagaattgaaaatgcattatccagatttccctgatgtgagttctggggtttatgtatgtaaagtggttgaaggaacagctgctcaaagctctggattgagagatcacgatgtaattgtcaacataaatgggaaacctattactactacaactgatgttgttaaagctcttgacagtgattccctttccatggctgttcttcggggaaaagataatttgctcctgacagtcatacctgaaacaatcaattaaatatcttgttttaaagtgggattatctaaaaaaaaaaaaaccagttatatcacgtggtttgtattggagatgtgccaaacatggcaagaagtttttggatctttttcttacaaagaaaaatggatggttatcaacccaaatgcccatcaatgacagactggataaagcaaatgtggtacatatacaccatggaatactatgcagccataaaaagcaacagtcctctgcagggacatggatggagctggaaaccattatcctcagcaaactaacgcaggaacagaaaaccaaatactgcatgttctcacttataagtgggagctgaacaatgagaacacatgaacatagggaggggaacaacacacactggggcctggcagtgggtagggtagagggagggagagcattagcaaaaatagctaatgcatgctgggcttaacacccaggtgatgggttgattgataggtgcagcaaaccatcatggcacacatttacctatgaaacaaacctgcacatcctgcatatgtacctcagaacttaaaaataaaaataaaaagaaaaatg

SEQ ID NO: 141470 - DNA, 9027 bp, Homo sapiens
  Payload ID: 7817
  Gene Symbol: HIVEP1
  Gene Name: human immunodeficiency virus type I enhancer binding protein 1
  Uniprot ID: P15822
  ENST ID: ENST00000379388
  CDS Start-End: 333-8489
gctgctgggcggcggcagggtggcggacggagcgggggaccggggagcggcggccgccggaggaggttatgtttgtgtttggggttgtcaagtgaaggagggatcccaggcgccgccgccgccgccgcgcgggggtcgcggagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttta

SEQ ID NO: 141471 - DNA, 2085 bp, Homo sapiens
  Payload ID: 7817
  Gene Symbol: HIVEP1
  Gene Name: human immunodeficiency virus type I enhancer binding protein 1
  ENST ID: ENST00000399469
  CDS Start-End: 1-131
ttgcacttgctctccttaattcaaaacagaacactggaaaatcactatactgtcaagcaataactacccattccaagtcagacttattggtctattcaagcaagtggaaaagcagcttaagcaagatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgc

SEQ ID NO: 141472 - DNA, 1044 bp, Homo sapiens
  Payload ID: 7817
  Gene Symbol: HIVEP1
  Gene Name: human immunodeficiency virus type I enhancer binding protein 1
  ENST ID: ENST00000442081
  CDS Start-End: 324-1044
gcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagaggaaacgtggtgggtgccgttttgacaccgacctatcctttgtgaggttgaagaattttggaagagcatgagagcagcacttggtgttcagaagaaaggcttagcatgttgtcctgggttccgtggagaagggtcactggactgcacggggtggctcttccgcatggtcttgacaaaattgaagaagcacaaaaagaacttaatggggcagaagtttcaaaaaaagaaatcttacaggctggtgttaaaggaacttcggaatcccttaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctga

SEQ ID NO: 141473 - DNA, 585 bp, Homo sapiens
  Payload ID: 7817
  Gene Symbol: HIVEP1
  Gene Name: human immunodeficiency virus type I enhancer binding protein 1
  ENST ID: ENST00000487103
  CDS Start-End: 159-585
tcctcccgccggccccaaagacgctaaacgtgccctactctgccccgggggagagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaac

SEQ ID NO: 141474 - DNA, 576 bp, Homo sapiens
  Payload ID: 7817
  Gene Symbol: HIVEP1
  Gene Name: human immunodeficiency virus type I enhancer binding protein 1
  ENST ID: ENST00000478545
  CDS Start-End: 192-576
gtgcaaccgccgaccttgcagaggggatggctgcgtgcgggagacccttggcacttctgggcgccctcgccgcgcgcgagccgagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctg

SEQ ID NO: 141475 - DNA, 1602 bp, Homo sapiens
  Payload ID: 7817
  Gene Symbol: HIVEP1
  Gene Name: human immunodeficiency virus type I enhancer binding protein 1
  ENST ID: ENST00000484210
  CDS Start-End: 43-186
tgcagtttttaagaagaaaaagaaggccctgagtcaaagaagatgcctcgaactaaacaaattcatcccagaaatctaagagggtcttgctcttttgctcaggctggagtgcagtggtgtagttgtagctcactgcaaccccaaacttctggggacaagctaaggcttgtccccttcctgctttagcgtcccgaatagcttggactacaggcacatgccagtgtgcctagctactttttttttttggcggaggggaggggagttcctcactttgttgcccagactggtcttgaactcccagcctcaagtgaacctcctgtgttggccccccaaagcactgagattacaggcatgagccaccgcacctagtctgtggtttttcttcttcttatttttaaacatcctgtgcagaaaaaaattaaggaacctgatgtatctgttagacattaataccgtgcaaattcagtatgttttagtgttttgatctattgatatcctttctattgaaggcaaggaacaatagttattcggggctttattagattttatttaatgctttcataaagaagcacagatattactatttatcaactgtaatttttaatatttgagaactatattttggtgtaattgtttttttaatcctgtgtattttatgcattttaaaacattctgaaaaggggtccatcaatttggctaaactgcagaggcatacagggtacacagaaaaagttaagaatcatcctctggatgggcgcggtggctcacgattgtaatcccagcactttgggaggctgaggcaggcagatcacgaggtcaagagattgagaccatcctggccaacatgccgaaaccccgtctgtactaaaaatacaaaaattagctgggcatggtggcatgcacttgtagtcccagctacttgggaggctgaggcaggataattgcttgaagccaggaggcggaggttgcagtgagccaagattgcgccactgcactccagcctgggcgacagggcgagactccatctcaacaacgacaacaacaacaacaacaacaaagaaccaacaacaacaacaacaaagaaccaccaccaccaccaccaacaacaacaacaaagaatcattctccattccccaaaccctaaagccaggaagggagtaagattaactttagaaattaataaatagagttttggatctctactctgccttttaggagctctgtggatgggacgttttacttctgactgtcattctctgtgttataaaatgagtataatatatctgtcacagatttgtgatgagagttaaaatggacactttatataatatacctggcagagtaacaggcacatagaatgaatgttgttacccctttggtccttagtcttatcatgaactagctatgtccttagccaaattacttaccactttttgatctttgttacctatttatctacactgaaaggatttagatttgtatatttctacttcagctaaaaaaaatctgtgattatgtaaaaaaccaggattacctttttcaaattggaatgcttggtcagctaagcttttattttgttgattaaagacatgcatatatcaa

SEQ ID NO: 141476 - DNA, 579 bp, Homo sapiens
  Payload ID: 7817
  Gene Symbol: HIVEP1
  Gene Name: human immunodeficiency virus type I enhancer binding protein 1
  ENST ID: ENST00000491710
  CDS Start-End: 218-579
tttcctctcacgcccacttccaacctaggaggcttttggtttctgcttttttgtttttaaaattaaaagttaaacccaggaagctttggatcagacttttgtgttgcagttcggcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctga

SEQ ID NO: 141477 - DNA, 9023 bp, Homo sapiens
  Payload ID: 7817
  Gene Symbol: HIVEP1
  Gene Name: human immunodeficiency virus type I enhancer binding protein 1
  ENST ID: ENST00000541134
  CDS Start-End: 333-8486
gctgctgggcggcggcagggtggcggacggagcgggggaccggggagcggcggccgccggaggaggttatgtttgtgtttggggttgtcaagtgaaggagggatcccaggcgccgccgccgccgccgcgcgggggtcgcggagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggagggcaatcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttt
